US008895271B2

(12) United States Patent
Bong et al.

(10) Patent No.: US 8,895,271 B2
(45) Date of Patent: Nov. 25, 2014

(54) SYNTHESIS OF PRAZOLE COMPOUNDS

(75) Inventors: Yong Koy Bong, Singapore (SG);
Michael D. Clay, Menlo Park, CA (US);
Steven J. Collier, Singapore (SG);
Benjamin Mijts, Redwood City, CA (US); Michael Vogel, Rhauderfehn (DE);
Xiyun Zhang, Redwood City, CA (US);
Jun Zhu, Shanghai (CN); Jovana Nazor, Redwood City, CA (US); Derek Smith, Redwood City, CA (US); Shiwei Song, Singapore (SG)

(73) Assignee: Codexis, Inc., Redwood City, CA (US)

( * ) Notice: Subject to any disclaimer, the term of this patent is extended or adjusted under 35 U.S.C. 154(b) by 228 days.

(21) Appl. No.: 13/514,750

(22) PCT Filed: Dec. 8, 2010

(86) PCT No.: PCT/US2010/059398
§ 371 (c)(1),
(2), (4) Date: Jun. 8, 2012

(87) PCT Pub. No.: WO2011/071982
PCT Pub. Date: Jun. 16, 2011

(65) Prior Publication Data
US 2013/0017580 A1 Jan. 17, 2013

Related U.S. Application Data

(60) Provisional application No. 61/267,812, filed on Dec. 8, 2009.

(51) Int. Cl.
*C12Q 1/44* (2006.01)
*C12N 9/00* (2006.01)
*C12N 9/02* (2006.01)
*C12N 1/20* (2006.01)
*C12N 15/00* (2006.01)
*C07H 21/04* (2006.01)
*C12P 17/18* (2006.01)

(52) U.S. Cl.
CPC ............. *C12P 17/182* (2013.01); *C12N 9/0083* (2013.01)
USPC ........ 435/119; 435/183; 435/189; 435/252.3; 435/320.1; 536/23.2

(58) Field of Classification Search
None
See application file for complete search history.

(56) References Cited

U.S. PATENT DOCUMENTS

| 5,840,552 | A | 11/1998 | Holt et al. |
| 6,117,679 | A | 9/2000 | Stemmer et al. |
| 6,162,816 | A | 12/2000 | Bohlin et al. |
| 6,369,085 | B1 | 4/2002 | Cotton et al. |
| 6,376,246 | B1 | 4/2002 | Crameri et al. |
| 6,537,746 | B2 | 3/2003 | Arnold et al. |
| 6,586,182 | B1 | 7/2003 | Patten et al. |
| 7,105,296 | B2 | 9/2006 | Brammucci et al. |
| 7,214,520 | B2 | 5/2007 | Iwaki et al. |
| 7,541,168 | B2 | 6/2009 | Iwaki et al. |
| 7,553,646 | B2 | 6/2009 | Olivo et al. |
| 2003/0087403 | A1 | 5/2003 | Cheng et al. |
| 2008/0004447 | A1 | 1/2008 | Gustavsson |
| 2008/0220990 | A1 | 9/2008 | Fox |
| 2009/0312196 | A1 | 12/2009 | Colbeck et al. |

FOREIGN PATENT DOCUMENTS

EP 795024 B1 2/2003

OTHER PUBLICATIONS

Chica et al. Curr Opin Biotechnol. Aug. 2005;16(4):378-84.*
Sen et al. Appl Biochem Biotechnol. Dec. 2007;143(3):212-23.*
Kayser et al., "New Bioorganic Reagents: Evolved Cyclohexanone Monooxygenase—Why Is It More Selective?," J. Org. Chem., 71:8424-8430 [2006].
Shainsky et al., "Rapid Methods for High-Throughput Detection of Sulfoxides," Applied and Environ. Microbiol. 75 (14): 4711-19 [Jul. 2009].
Sun et al., "Synthesis of Optically Active 2,5-Dialkylcyclohexane-1,4-diols and Their Application in the Asymmetric Oxidation of Sulfides," Synthesis 16: 2513-18 [2008].
Cotton, et al., "Asymmetric Synthesis of Esomeprazole," Tetrahedon Asymetry vol. 11-18:3819, 2000.
Sheng et al., "Mechanistic Studies of Cyclohexanone Monooxygenase: Chemical Properties of Intermediates Involved in Catalysis" Biochemistry 40 37:11156-67, 2001.
Malito et al, "Revealing the Moonlighting Role of NADP in the Structure of a Flavin-Containing Monooxygenase" Pro. Natl. Acad. Sci. 101(36):13157-13162, 2004.
Light et al, "Studies on the Chirality of Sulfoxidation Catalyzed by Bacterial Flavoenzyme Cyclohexanone Monooxygenase and Hog Liver Flavin Adenine Dinucleotide Containing Monooxygenase" Biochemistry, 21 (10):2490-8, 1982.
Reetz et al., "Directed Evolution of Cyclohexanone Monooxygenases: Enantioselective Biocatalysts for the Oxidation of Prochiral Thioethers," Angew Chem Int. Ed, 43:4078-4081, 2004.
Pasta et al., "Synthesis of Chiral Benzyl Alkyl Sulfoxides by Cyclohexanone Monooxygenase from Acinetobacter NCIB 9871" Tetrahedron: Asymmetry 6(4) 933-936, 1995.
Yeung et al., "Prochiral Sulfoxidation as a probe for Flavin-Containing Monooxygenases, In Methods in Molecular Biology: Cytochrome P450 Protocols," Meth. Mol. Biol. 320:163-172, 2005.
Alphand et al., "Towards Large-Scale Synthetic Applications of Baeyer-Villiger Monooxygenases," Trends Biotechnology 21(7):318-323, 2003.
Chen et al., "Acinetobacter Cyclohexanone Monooxygenase: Gene Cloning and Sequence Determination," J Bacteriol. 170 (2), 781-789, 1988.
Genbank No. Q9F7E4 dated Oct. 31, 2006.
Genbank No. AAG10021 dated Sep. 3, 2000.
Genbank No. AAA21892 dated Apr. 24, 1993.
Genbank No. BAA86293 dated Nov. 20, 2008.
Genbank No. P12015 dated Nov. 4, 2008.

(Continued)

*Primary Examiner* — Christian Fronda
(74) *Attorney, Agent, or Firm* — Codexis, Inc.

(57) ABSTRACT

The present disclosure relates to non-naturally occurring monooxygenase polypeptides useful for preparing prazole compounds, polynucleotides encoding the polypeptides, and methods of using the polypeptides.

11 Claims, No Drawings

(56) References Cited

OTHER PUBLICATIONS

Secundo, et al., "Asymetric Oxidation of Sulfides by Cyclohexanone Monooxygenase," Tetrahedron: Asymmetry, 4(9) 1981-1982, 1993.

International Search Report and Written Opinion to PCT/US2010/059398 mailed Oct. 25, 2011.

Secundo, et al, "Cheminform Abstract: Asymmetric Oxidation of Sulfides by Cyclohexanone Monooxygenase," Cheminform, 25, 1994.

Chen, et al., "Asymmetric oxidations at sulfur catalyzed by engineered strains that overexpress cyclohexanone monooxygenase," New J Chem, 23, 827, 1999.

Bocola, et al., "Converting Phenylacetone Monooxygenase into Phenylcyclohexanone Monooxygenase by Rational Design: Towards Practical Baeyer-Villiger Monooxygenases," Adv. Synth. Catal. 347, 979.

Hollman, et al., "A Light-Driven Stereoselective Biocatalytic Oxidation," Angew Chemie, 119, 2961, 2007.

Mihovilovic, et al., "Asymmetric Baeyer-Villiger Oxidations of 4-Mono- and 4,4-Disubstituted Cyclohexanones by Whole Cells of Engineered *Escherichia coli*," J. Org. Chem. 66:733-738, 2001.

Mihovilovic, et a., Microbial Baeyer-Villiger Oxidation: Stereopreference and Substrate Acceptance of Cyclohexanone Monooxygenase Mutants Prepared by Directed Evolution, Org. Ltrs., vol. 8, No. 6, 1221, 2006.

Mirza, et al., "Crystal Structures of Cyclohexanone Monooxygenase Reveal Complex Domain Movements and a Sliding Cofactor," J. Am. Chem. Soc. vol. 131, No. 25, 8850, 2009.

Reetz, et al., "Directed Evolution as a Method to Create Enantioselective Cyclohexanone Monooxygenases for Catalysis in Baeyer-Villiger Reactions," Angew Chem Int. Ed, 43:4075-4078, 2004.

Shulz, et al., "Towards Practical Biocatalytic Baeyer-Villiger Reactions: applying a thermostable enzyme in the gram-scale synthesis of optically-active lactones in a two-liquid-phase system," Beilstein J. Org. Chem., vol. 1:30, 2005.

Cheesman, et al., "Critical role of Histidine Residues in Cyclohexanone Monooxygenase Expression, Cofactor Binding and Catalysis," ChemicoBiol Interact. vol. 146, 157-164, 2003.

Clouthier, C.M., et al., "Designing new Baeyer-Villiger monooxygenases using restricted CASTing," J. Org. Chem., 71(22):8431-7 [2006].

Garnock-Jones, K.P., et al., "Armodafinil," CNS Drugs, 23(9): 793-803 [2009].

Kayser, M.M., "'Designer reagents' recombinant microorganisms: new and powerful tools for organic synthesis," Tetrahedron, 65:947-974 [2009].

Mihovilovic, M.D., et al., "Biooxidations in Chiral Synthesis," in Asymmetric Organic Synthesis with Enzymes, Wiley-VCH Verlag GmbH & Co KGaA, Chapter 9, pp. 229-274, [2008].

Olivo, H.F., et al., "Microbial oxidation/amidation of benzhydrylsulfanyl acetic acid. Synthesis of (+)-modafinil," Tetrahedron: Asymmetry, 16:3507-3511 [2005].

Schulz, F., "Monooxygenases. Experiments to turn a class of enzymes into a toolbox for biocatalysis," Dissertation, pp. 1-233 [2007].

UniProt Accession No. Q9R2F5_9GAMM, retrieved Mar. 24, 2012 from www.uniprot.org/uniprot.

International Search Report from International Application No. PCT/US2011/063809.

* cited by examiner

SYNTHESIS OF PRAZOLE COMPOUNDS

CROSS REFERENCE TO RELATED APPLICATIONS

The present application is a national stage application filed under 35 USC §371 and claims priority of the international application PCT/US2010/059398, filed Dec. 8, 2010, and U.S. provisional patent application 61/267,812, filed Dec. 8, 2009, which is hereby incorporated by reference herein.

1. TECHNICAL FIELD

The present disclosure relates to biocatalysts and methods of using the biocatalysts.

2. REFERENCE TO SEQUENCE LISTING, TABLE OR COMPUTER PROGRAM

The Sequence Listing is concurrently submitted herewith the specification as an ASCII formatted text file via EFS-Web with a file name of CX2-036WO1_ST25.txt with a creation date of Dec. 7, 2010, and a size of 955175 bytes. The Sequence Listing filed via EFS-Web is part of the specification and is hereby incorporated in its entirety by reference herein.

3. BACKGROUND

Esomeprazole is a proton pump inhibitor prescribed for the treatment of dyspepsia, peptic ulcer disease (PUD), gastroesophageal reflux disease (GORD/GERD) and Zollinger-Ellison syndrome. Esomeprazole is the S-enantiomer of omeprazole, which is a racemic mixture of the S and R isomers. Esomeprazole (also referred to herein as "(S)-5-methoxy-2-((4-methoxy-3,5-dimethylpyridin-2-yl)methylsulfinyl)-1H-benzo[d]imidazole" or "compound (2b)") has the following structure:

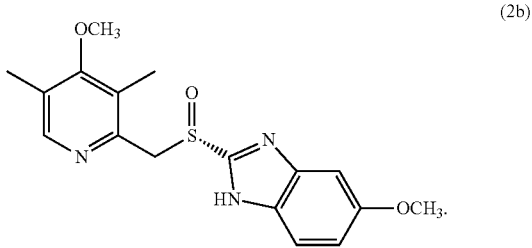 [SMILES: COc1ccc2[nH]c([S@@](=O)Cc3ncc(C)c(OC)c3C)nc2c1]

(2b)

Esomeprazole and its corresponding R-isomer is a prodrug that is converted to the active form in acidic environments. It is activated by a proton catalyzed process to form a sulphenamide, which interacts with the sulfhydryl groups of cysteine residues in the extracellular domain of H⁺K⁺-ATPases, thereby inhibiting its activity. The efficacy of the S-enantiomer is indicated as being greater than the racemic omeprazole.

Esomeprazole is typically synthesized by chemical asymmetric oxidation of sulfides to sulfoxides, i.e., a Kagan-Sharpless type oxidation, as described in Cotton et al., 2000, Tetrahedron: Asymmetry 11:3819. The process results in esomeprazole in about 94% enantiomeric excess. The enantiopurity of esomeprazole preparations can be increased substantially by preparing a magnesium salt followed by crystallization. Different salts and hydrates of esomeprazole have also been described. For example, WO 00/44744 discloses the potassium salt of esomeprazole. U.S. Pat. No. 6,162,816 discloses crystalline form A and less crystalline form B of neutral esomeprazole, prepared by a recrystallization from ethyl acetate, methylene chloride or toluene. U.S. Pat. No. 6,369,085 discloses esomeprazole magnesium trihydrate prepared from the corresponding potassium salt, precipitated with acetone, and treated with water.

However, it is desirable to increase the efficiency of manufacture as well as reducing the number of processing steps for forming esomeprazole preparations of high enantiopurity. It is also desirable to identify processes that are applicable to preparation of other prazole compounds in addition to esomeprazole.

4. SUMMARY

The present disclosure provides polypeptides, polynucleotides encoding the polypeptides and methods of using the polypeptides for the biocatalytic sulfoxidation of prazole compounds, in particular the conversion of the sulfide substrate of 5-methoxy-2-((4-methoxy-3,5-dimethylpyridin-2-yl)methylthio)-1H-benzo[d]imidazole (also referred to herein as "compound (1)") to the (R)- and (S)-omeprazole product of 5-methoxy-2-((4-methoxy-3,5-dimethylpyridin-2-yl)methylsulfinyl)-1H-benzo[d]imidazole (also referred to herein as "compound (2)").

While naturally occurring cyclohexanone monooxygenase (CHMO) polypeptides do not efficiently convert compound (1) to compound (2), the non-naturally occurring monooxygenase polypeptides (also referred to herein as "engineered CHMO polypeptides") of the present disclosure have been designed to efficiently carryout the conversion. Moreover, in some embodiments, the non-naturally occurring monooxygenase polypeptides of the disclosure can carry out the reaction stereoselectively to the form the S-isomer, (S)-5-methoxy-2-((4-methoxy-3,5-dimethylpyridin-2-yl)methylsulfinyl)-1H-benzo[d]imidazole (also referred to herein as "compound (2b)") in enantiomeric excess over the R-isomer, or in some embodiments, to form (R)-5-methoxy-2-((4-methoxy-3,5-dimethylpyridin-2-yl)methylsulfinyl)-1H-benzo[d]imidazole (also referred to herein as "compound (2a)") in enantiomeric excess over the S-isomer. In some embodiments, the monooxygenase polypeptides can produce compound (2b) as a substantially enantiomerically pure preparation.

In some embodiments, the polypeptide is capable of converting compound (1) to compound (2a) in enantiomeric excess. In some embodiments, the R-enantioselective monooxygenase polypeptide comprises an amino acid sequence that is at least 80%, 85%, 86%, 87%, 88%, 89%, 90%, 91%, 92%, 93%, 94%, 95%, 96%, 97%, 98%, 99%, or more identical to a reference sequence selected from the group consisting of SEQ ID NO: 4, 6, 160, 162, 164, 166, 168, 170, 172, 174, 176, 178, 180, 182, 184, 186, 188, 190, 192, 194, 196, 198, 200, 202, 204, 206, and 208. In particular, the reference sequence is SEQ ID NO: 6, 166, 170, 174, 190, 192, 196, 200, 204, or 206.

In some embodiments, the polypeptide is capable of converting compound (1) to compound (2b) in enantiomeric excess. In some embodiments, the S-enantioselective monooxygenase polypeptide comprises an amino acid sequence that is at least 80%, 85%, 86%, 87%, 88%, 89%, 90%, 91%, 92%, 93%, 94%, 95%, 96%, 97%, 98%, 99%, or more identical to a reference sequence selected from the group consisting of SEQ ID NO: 8, 10, 22, 52, 76, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266. In particular, the reference sequence is SEQ ID NO: 116, 124, 130, 138, or 158.

Additionally, the present disclosure provides a monooxygenase polypeptide capable of converting compound (1) to compound (2) at a rate that is improved over the naturally occurring monooxygenase of SEQ ID NO:2. In some embodiments, the non-naturally occurring monooxygenase polypeptide of the disclosure are capable of converting compound (1) to compound (2) at a rate that is greater than 1.5 fold the rate of SEQ ID NO:2. In some embodiments, the polypeptide is capable of converting compound (1) to compound (2) at a rate that is greater than 1.5 fold the polypeptide of SEQ ID NO:2 and comprises an amino acid sequence that is at least 80%, 85%, 86%, 87%, 88%, 89%, 90%, 91%, 92%, 93%, 94%, 95%, 96%, 97%, 98%, 99%, or more identical to a reference sequence selected from SEQ ID NO: 4, 6, 8, 10, 22, 52, 76, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, or 266. In particular, the reference sequence is SEQ ID NO: 116, 124, 130, 138, or 158.

The polypeptide capable of converting compound (1) to compound (2) with improved enantioselectivity and/or enzymatic activity, having been derived from the naturally occurring cyclohexanone monooxygenase of *Acinetobacter* NCIMB9871, comprises an amino acid sequence that has one or more residue differences as compared to the sequence of SEQ ID NO:2. The residue differences can occur at residue positions identified as being associated with desirable changes in enzyme activity, enantioselectivity, sulfone-byproduct formation, thermostability, solvent stability, expression, or various combinations thereof. Accordingly, in some embodiments, the polypeptides of the disclosure can have one or more residue differences as compared to SEQ ID NO:2 at the following residue positions: X3; X14; X34; X43; X71; X111; X141; X149; X174; X209; X240; X246; X248; X288; X307; X326; X383; X386; X388; X390; X400; X415; X426; X432; X433; X435; X438; X448; X449; X481; X488; X489; X490; X499; X505; X516; X526; X537; and X540. In some embodiments, the monooxygenase amino acid sequence has at least two or more, at least three or more, or at least four or more residue differences at the residue positions above as compared to the reference sequence of SEQ ID NO:2. Amino acid residues that can be present at these positions are provided in the detailed descriptions herein.

In some embodiments, the polypeptide comprises an amino acid sequence having one or more residue differences as compared to SEQ ID NO:2 at residue positions associated with changes in enantioselectivity, which positions are selected from the following: X246; X248; X326; X386; X432; X433; X435; X438; and X448. In some embodiments, the monooxygenase has at least two or more, at least three or more, or at least four or more residue differences at these residues positions as compared to the reference sequence of SEQ ID NO:2.

In some embodiments, the non-naturally occurring monooxygenase polypeptide comprises an amino acid sequence having one or more residue differences as compared to SEQ ID NO:2 at residue positions associated with decreases in sulfone-byproduct formation, where the sulfone-byproduct has the following structure of compound (3):

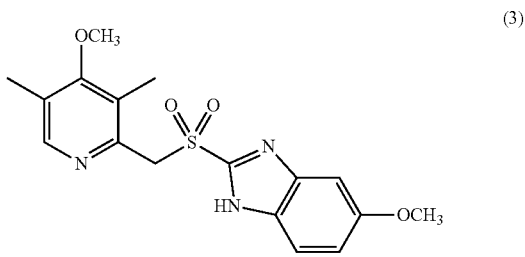 [SMILES: COc1ccc2[nH]c(S(=O)(=O)Cc3ncc(C)c(OC)c3C)nc2c1]

(3)

Residue positions associated with a decrease in the amount of sulfone-byproduct of compound (3) formed in the biocatalytic process can be selected from the following: X246, X248, X277, and X438.

In some embodiments, the polypeptide comprises an amino acid sequence having one or more residue differences as compared to SEQ ID NO:2 at residue positions associated with increases in thermostability and/or solvent stability, which positions are selected from the following: X43, X71, X111, X149, X174, X307; X341, X368, X388, X390, X400, X449, X481, and X488.

In some embodiments, the polypeptide comprises an amino acid sequence having residue differences as compared to SEQ ID NO:2 at residue positions associated with increases in protein expression, which position includes X3.

As will be apparent to the skilled artisan, various combinations of residue differences as compared to SEQ ID NO:2 at residue positions associated with desirable changes in enzymatic activity, enantioselectivity, sulfone-byproduct formation, thermostability, solvent stability and expression can be used to form the polypeptides of the present disclosure.

In some embodiments, the polypeptide capable of converting compound (1) to compound (2a) in enantiomeric excess (R-enantioselective) comprises an amino acid sequence which comprises at least two or more of the following features: residue at position corresponding to X432 is an aliphatic amino acid residue; residue at position corresponding to X433 is a non-polar amino acid residue; residue at position corresponding to X435 is a hydroxyl-containing amino acid residue; and residue at position corresponding to X490 is a basic amino acid residue. In some embodiments, the R-enantioselective monooxygenases have at least three of the above features, or at least all of the above features.

In some embodiments, the polypeptide capable of converting compound (1) to compound (2b) in enantiomeric excess (S-selective) comprises an amino acid sequence in which at least residue at position corresponding to X326 is a cysteine (C). In some embodiments, the polypeptide capable of converting compound (1) to compound (2b) in enantiomeric excess comprises an amino acid sequence in which at least residue at position corresponding to X386 is a hydroxyl-containing amino acid residue, particularly a S.

In some embodiments, the polypeptide capable of converting compound (1) to compound (2b) in enantiomeric excess comprises an amino acid sequence which includes at least the following features: residue at position corresponding to X326 is a cysteine (C) and residue at position corresponding to X386 is a hydroxyl-containing amino acid residue, particularly a S.

In some embodiments, the S-enantioselective monooxygenase polypeptides comprises an amino acid sequence having, in addition to residue differences associated with S-enantioselectivity above, at least one or more residue differences at residue positions associated with increased enzyme activity for the pyrmetazole substrate and/or increased S-enantioselectivity, particularly at residue positions X432, X433, X435, X438, X448, and X490, more particularly at least one or more residue differences at residue positions X432, X433, X435, and X490.

Thus, in some embodiments, the polypeptide capable of converting compound (1) to compound (2b) in enantiomeric excess comprises an amino acid sequence which includes at least the following features: residue at position corresponding to X326 is a cysteine (C); residue at position corresponding to X386 is a hydroxyl-containing amino acid residue; and residue at position corresponding to X432 is an aliphatic amino acid residue.

In some embodiments, the polypeptide capable of converting compound (1) to compound (2b) in enantiomeric excess comprises an amino acid sequence which includes at least the following features: residue at position corresponding to X326 is a cysteine (C); residue at position corresponding to X386 is a hydroxyl-containing amino acid residue; residue at position corresponding to X432 is an aliphatic amino acid residue; residue at position corresponding to X433 is an aliphatic amino acid residue, residue at position corresponding to X435 is a hydroxyl-containing amino acid residue; and residue at position corresponding to X490 is a basic amino acid residue.

In some embodiments, the polypeptide capable of converting compound (1) to compound (2b) in enantiomeric excess comprises an amino acid sequence which includes at least the following features: residue at position corresponding to X326 is C; residue at position corresponding to X386 is S; residue at position corresponding to X432 is A, or L; residue at position corresponding to X433 is A, L, or V; residue at position corresponding to X435 is S; and residue at position corresponding to X490 is R.

In some embodiments, the polypeptide capable of converting compound (1) to compound (2b) in enantiomeric excess comprises an amino acid sequence which includes at least the following features: residue at position corresponding to X34 is K; residue at position corresponding to X209 is P; residue at position corresponding to X240 is F or K; residue at position corresponding to X288 is I; residue at position corresponding to X326 is C; residue at position corresponding to X386 is S; residue at position corresponding to X415 is A; residue at position corresponding to X432 is L; residue at position corresponding to X433 is A; residue at position corresponding to X435 is S; residue at position corresponding to X438 is I; residue at position corresponding to X448 is V; residue at position corresponding to X490 is R; residue at position corresponding to X516 is V; and residue at position corresponding to X537 is T.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X141 is V; residue at position corresponding to X209 is P; residue at position corresponding to X240 is F or K; residue at position corresponding to X288 is I; residue at position corresponding to X326 is C; residue at position corresponding to X386 is S; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X489 is C; residue at position corresponding to X490 is R; residue at position corresponding to X516 is V; and residue at position corresponding to X537 is T.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X111 is T; residue at position corresponding to X141 is V; residue at position corresponding to X209 is P; residue at position corresponding to X240 is F or K; residue at position corresponding to X246 is Y; residue at position corresponding to X288 is I; residue at position corresponding to X307 is C or R; residue at position corresponding to X326 is C; residue at position corresponding to X386 is S; residue at position corresponding to X388 is K; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X481 is K; residue at position corresponding to X489 is C; residue at position corresponding to X490 is R; residue at position corresponding to X505 is L; residue at position corresponding to X516 is V; and residue at position corresponding to X537 is T.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X43 is G; residue at position corresponding to X71 is M; residue at position corresponding to X111 is T; residue at position corresponding to X141 is V; residue at position corresponding to X149 is W; residue at position corresponding to X209 is P; residue at position corresponding to X240 is F or K; residue at position corresponding to X246 is Y; residue at position corresponding to X248 is I or V; residue at position corresponding to X277 is M; residue at position corresponding to X288 is I; residue at position corresponding to X307 is C or R; residue at position corresponding to X326 is C; residue at position corresponding to X386 is S; residue at position corresponding to X388 is K; residue at position corresponding to X390 is I; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X481 is K; residue at position corresponding to X489 is C; residue at position corresponding to X490 is R; residue at position corresponding to X499 is G, L, or R; residue at position corresponding to X505 is L; residue at position corresponding to X516 is V; residue at position corresponding to X526 is V; residue at position corresponding to X537 is T; and residue at position corresponding to X540 is Q.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X43 is G; residue at position corresponding to X71 is M; residue at position corresponding to X111 is T; residue at position corresponding to X141 is V;

residue at position corresponding to X149 is W; residue at position corresponding to X174 is I; residue at position corresponding to X209 is P; residue at position corresponding to X240 is F or K; residue at position corresponding to X246 is Y; residue at position corresponding to X248 is I or V; residue at position corresponding to X277 is M; residue at position corresponding to X288 is I; residue at position corresponding to X307 is C or R; residue at position corresponding to X326 is C; residue at position corresponding to X341 is E; residue at position corresponding to X383 is G; residue at position corresponding to X386 is S; residue at position corresponding to X388 is K; residue at position corresponding to X390 is I; residue at position corresponding to X400 is I; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X449 is F; residue at position corresponding to X481 is K; residue at position corresponding to X488 is K; residue at position corresponding to X489 is C; residue at position corresponding to X490 is R; residue at position corresponding to X499 is G, L, or R; residue at position corresponding to X505 is L; residue at position corresponding to X516 is V; residue at position corresponding to X526 is V; residue at position corresponding to X537 is T; and residue at position corresponding to X540 is Q.

In addition to the residue positions specified above, various other residue differences relative to SEQ ID NO:2 can be present at other residue positions in the non-naturally occurring monooxygenase polypeptides disclosed herein. These can be conservative or non-conservative differences, including conservative substitutions and non-conservative substitutions. Guidance on these other residue positions and the choices of amino acid residues at these other specified positions is provided in the detailed description.

In another aspect, provided herein are polynucleotides encoding the monooxygenase polypeptides, expression vectors comprising the polynucleotides, and host cells capable of expressing the polypeptides.

In a further aspect, provided herein are processes of using the polypeptides of the disclosure for converting a substrate compound of structural formula (I) to the product compound of formula (II):

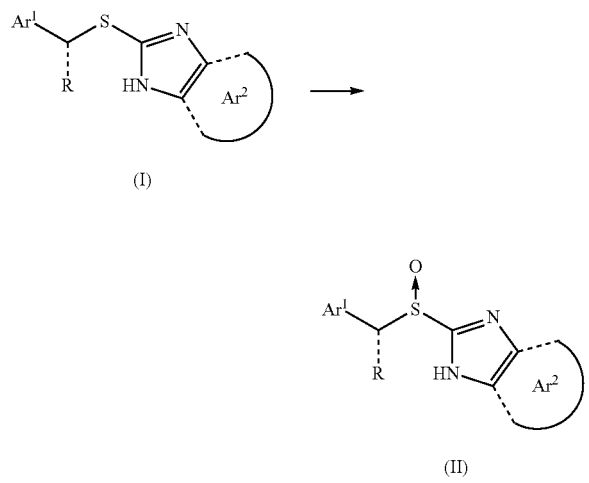

wherein,

Ar$^1$ is an optionally substituted aryl or heteroaryl ring;

R is H, a lower alkyl, a heteroalkyl, or forms a 5 to 8 membered cycloalkyl, heteroalkyl, aryl or heteroaryl fused ring with a ring carbon of Ar$^1$; and Ar$^2$ is an optionally substituted cycloalkyl, heterocycloalkyl, aryl, or heteroaryl ring fused to the imidazole ring.

Generally, the process comprises contacting the compound of formula (I) with an engineered monooxygenase polypeptide described herein in presence of a cofactor under suitable reaction conditions for converting the substrate to the product compound of formula (II). The suitable reaction conditions typically include a source of molecular oxygen $O_2$, and the cofactor is NADPH or NADH.

processes of using the polypeptides of the disclosure can be used in the preparation of omeprazole analog compounds of structural formula (II) in enantiomeric excess, wherein the compounds of structural formula (II) are selected from: (R) or (S)-lansoprazole, (R) or (3)-tenatoprazole, (R) or (S)-rabeprazole, (R) or (S)-pantoprazole, (R) or (S)-ilaprazole, (R) or (S)-leminoprazole, (R) or (S)-saviprazole, and (R) or (S)-TY-11345.

In some embodiments, Ar$^1$ is an optionally substituted phenyl or pyridyl. In some embodiments, Ar$^2$ is an optionally substituted thienyl, phenyl or pyridyl. In some embodiments, the compound of formula (I) is compound (1) and the product compound of formula (II) is compound (2).

Exemplary polypeptides useful in the above process can comprise an amino acid sequence selected from the group consisting of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78. 80. 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, and 266, or an engineered CHMO polypeptide that comprises an amino acid sequence having any one of the sets of amino acid differences relative to SEQ ID NO: 2 for these polypeptides that are listed in Table 2A or 2B.

In some embodiments, the process is used for the conversion of compound (1) to compound (2a) in enantiomeric excess. In some embodiments, the process comprises contacting compound (1) with certain monooxygenase polypeptides described herein in presence of a cofactor under suitable reaction conditions for forming compound (2a) in enantiomeric excess. Exemplary polypeptides useful in the process for preparing compound (2a) in enantiomeric excess can comprise an amino acid sequence selected from the group consisting of SEQ ID NO: 4, 6, 160, 162, 164, 166, 168, 170, 172, 174, 176, 178, 180, 182, 184, 186, 188, 190, 192, 194, 196, 198, 200, 202, 204, 206, and 208.

In some embodiments, the process is used for the conversion of compound (1) to compound (2b) in enantiomeric excess. In some embodiments, the process comprises contacting compound (1) with certain monooxygenase polypeptides described herein in presence of a cofactor under suitable reaction conditions for forming compound (2b) in enantiomeric excess. Exemplary polypeptides useful in, the process for preparing compound (2b) in enantiomeric excess can comprise an amino acid sequence selected from the group consisting of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78. 80. 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266.

In some embodiments, the process can comprise contacting compound (1) with a polypeptide of the disclosure in presence of a cofactor under suitable reaction conditions to form compound (2b) in at least 90% enantiomeric excess. Exemplary polypeptides for preparing compound (2b) in at least 90% enantiomeric excess can comprise an amino acid sequence selected from the group consisting of SEQ ID NO: 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 242, 244, 248, 250, 254, 256, 258, 262, and 264.

In some embodiments, the process comprises contacting compound (1) with a polypeptide of the disclosure in presence of a cofactor under suitable reaction conditions to form compound (2b) in at least 99% enantiomeric excess. Exemplary polypeptides for preparing compound (2b) in at least 99% enantiomeric excess can comprise an amino acid sequence selected from the group consisting of SEQ ID NO: 16, 18, 20, 22, 24, 26, 28, 30, 32, 42, 44, 86, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, and 158.

In some embodiments, the reaction condition in the process comprises a temperature of 10° C. to 50° C., and in particular 25° C. to 40° C.

In some embodiments, the reaction condition in the process comprises a pH of about 8.5 to a pH of about 10, in particular a pH of about 8.5 to about 9.0.

In some embodiments, the reaction condition in the process comprises a partial pressure of $O_2$ at greater than atmospheric pressure. Additionally, dissolved molecular oxygen in the process can be increased by sparging the reaction solution with $O_2$-containing gas or by use of bubble-free aeration with $O_2$-containing gas.

In some embodiments of the process, the reaction condition comprises a co-solvent, such as for example, MeOH, EtOH, isopropanol (IPA), acetone, toluene, MeCN, methyl tert-butyl ether (MTBE), N-methyl-2-pyrrolidone (NMP), dimethylacetamide (DMAc), dimethylformamide (DMF), propylene glycol, polyethylene glycol (PEG), tetramethylurea, N-ethylpyrollidinone, tetraglyme, 1,3-Dimethyl-3,4,5,6-tetrahydro-2(1H)-pyrimidinone (DMPU), DMIU, hexamethylphosphoramide (HMPA) and dimethylsulfoxide (DMSO). The co-solvent can reduce the formation of aggregates which can affect the rate and scalability of the process.

In some embodiments, the process further comprises converting $NADP^+$ or NAD+ formed from the NADPH or NADH, respectively, with a cofactor regenerating system. The cofactor regenerating system can use an appropriate dehydrogenase, such a glucose dehydrogenase, glucose-phosphate dehydrogenase, formate dehydrogenase, phosphite dehydrogenase, and ketoreductase/alcohol dehydrogenase and corresponding substrate, for example, glucose, glucose-6-phosphate, formate, phosphite, or alcohol, respectively. In some embodiments, the co-factor regenerating system is a ketoreductase and a secondary alcohol, particularly isopropanol (IPA).

In a further aspect, the engineered monooxygenase polypeptides can be provided in the form of kits or arrays, particularly for use in the screening for activity on other prazole compounds of interest.

5. DETAILED DESCRIPTION

The present disclosure provides efficient biocatalysts capable of mediating the conversion of the substrate, 5-methoxy-2-((4-methoxy-3,5-dimethylpyridin-2-yl)methylthio)-1H-benzo[d]imidazole ("compound (1)") to the product, 5-methoxy-2-((4-methoxy-3,5-dimethylpyridin-2-yl)methylsulfinyl)-1H-benzo[d]imidazole ("compound (2)"). In some embodiments, the biocatalysts are highly stereoselective, capable of mediating the conversion of compound (1) to either the (S)-isomer of compound (2b) or the (R)-isomer of compound (2a) in enantiomeric excess. The biocatalysts described herein have been designed by changing the amino acid sequence of a naturally occurring cyclohexanone monooxygenase (CHMO) to form polypeptides with the desired enzymatic properties, e.g., enzyme activity, enantioselectivity, byproduct formation, thermostability, solvent stability, and expression. These polypeptides can also be applied to the sulfoxidation of other prazole compounds structurally similar to esomeprazole.

The detailed description that follow describes these engineered monooxygenase polypeptides and processes for carrying out the sulfoxidation of prazole compounds, in particular the conversion of compound (1) to compound (2). In some embodiments, the detailed description further provides monooxygenase polypeptides for the conversion of compound (1) to compound (2b) in enantiomeric excess.

For the descriptions herein and the appended claims, the singular forms "a", "an" and "the" include plural referents unless the context clearly indicates otherwise. Thus, for example, reference to "a polypeptide" includes more than one polypeptide, and reference to "a compound" refers to more than one compound.

Also, the use of "or" means "and/or" unless stated otherwise. Similarly, "comprise," "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

It is to be understood that both the foregoing general description, including the drawings, and the following detailed description are exemplary and explanatory only and are not restrictive of this disclosure.

5.1 DEFINITIONS

The technical and scientific terms used in the descriptions herein will have the meanings commonly understood by one of ordinary skill in the art, unless specifically defined otherwise. Accordingly, the following terms are intended to have the following meanings.

"Protein", "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Coding sequence" refers to that portion of a nucleic acid (e.g., a gene) that encodes an amino acid sequence of a protein.

"Naturally occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity," "percent identity," and "percent identical" are used herein to refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence identity is performed using the BLAST and BLAST 2.0 algorithms (see e.g., Altschul et al., 1990, J. Mol. Biol. 215: 403-410 and Altschul et al., 1977, Nucleic Acids Res. 3389-3402). Software for performing BLAST analyses is publicly available through the National Center for Biotechnology Information website.

Briefly, the BLAST analyses involve first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=-4, and a comparison of both strands. For amino acid sequences, the BLASTP program uses as defaults a wordlength (W) of 3, an expectation (E) of 10, and the BLO-SUM62 scoring matrix (see Henikoff and Henikoff, 1989, Proc Natl Acad Sci USA 89:10915).

Numerous other algorithms are available that function similarly to BLAST in providing percent identity for two sequences. Optimal alignment of sequences for comparison can be conducted, e.g., by the local homology algorithm of Smith and Waterman, 1981, Adv. Appl. Math. 2:482, by the homology alignment algorithm of Needleman and Wunsch, 1970, J. Mol. Biol. 48:443, by the search for similarity method of Pearson and Lipman, 1988, Proc. Natl. Acad. Sci. USA 85:2444, by computerized implementations of these algorithms (GAP, BESTFIT, FASTA, and TFASTA in the GCG Wisconsin Software Package), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)). Additionally, determination of sequence alignment and percent sequence identity can employ the BESTFIT or GAP programs in the GCG Wisconsin Software package (Accelrys, Madison Wis.), using default parameters provided.

"Reference sequence" refers to a defined sequence to which another sequence is compared. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a comparison window to identify and compare local regions of sequence similarity.

The term "reference sequence" is not intended to be limited to wild-type sequences, and can include engineered or altered sequences. For example, in some embodiments, a "reference sequence" can be a previously engineered or altered amino acid sequence.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered monooxygenase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess.

"Highly stereoselective" refers to a chemical or enzymatic reaction that is capable of converting a substrate (e.g., 5-methoxy-2-((4-methoxy-3,5-dimethylpyridin-2-yl)methylthio)-1H-benzo[d]imidazole) to its corresponding stereoisomeric product (e.g., (S)-5-methoxy-2-((4-methoxy-3,5-dimethylpyridin-2-yl)methylsulfinyl)-1H-benzo[d]imidazole, or (R)-5-methoxy-2-((4-methoxy-3,5-dimethylpyridin-2-yl)methylsulfinyl)-1H-benzo[d]imidazole) with at least about 85% stereoisomeric excess.

"Increased enzymatic activity" or "increased activity" refers to an improved property of an engineered enzyme, which can be represented by an increase in specific activity (e.g., product produced/time/weight protein) or an increase in percent conversion of the substrate to the product (e.g., percent conversion of starting amount of substrate to product in a specified time period using a specified amount of monooxygenase) as compared to a reference enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. The monooxygenase activity can be measured by any one of standard assays used for measuring monooxygenases, such as change in substrate or product concentration, or change in concentration of the cofactor (in absence of a cofactor regenerating system). Comparisons of enzyme activities are made using a defined preparation of enzyme, a defined assay under a set condition, and one or more defined substrates, as further described in detail herein. Generally, when enzymes in cell lysates are compared, the numbers of cells and the amount of protein assayed are determined as well as use of identical expression systems and identical host cells to minimize variations in amount of enzyme produced by the host cells and present in the lysates.

"Conversion" refers to the enzymatic transformation of a substrate to the corresponding product. "Percent conversion" refers to the percent of the substrate that is converted to the product within a period of time under specified conditions. Thus, for example, the "enzymatic activity" or "activity" of a monooxygenase polypeptide can be expressed as "percent conversion" of the substrate to the product.

"Thermostable" or "thermal stable" are used interchangeably to refer to a polypeptide that is resistant to inactivation when exposed to a set of temperature conditions (e.g., 40-80° C.) for a period of time (e.g., 0.5-24 hrs) compared to the untreated enzyme, thus retaining a certain level of residual activity (e.g., more than 60% to 80% for example) after exposure to elevated temperatures.

"Solvent stable" refers to a polypeptide that maintains similar activity (more than e.g., 60% to 80%) after exposure to varying concentrations (e.g., 5-99%) of solvent, (e.g., isopropyl alcohol, dimethylsulfoxide, tetrahydrofuran, 2-methyltetrahydrofuran, acetone, toluene, butylacetate, methyl tert-butylether, acetonitrile, etc.) for a period of time (e.g., 0.5-24 hrs) compared to the untreated enzyme.

"Hydrophilic Amino Acid or Residue" refers to an amino acid or residue having a side chain exhibiting a hydrophobicity of less than zero according to the normalized consensus hydrophobicity scale of Eisenberg et al., 1984, *J. Mol. Biol.* 179:125-142. Genetically encoded hydrophilic amino acids include Thr (F), Ser (S), His (H), Glu (E), Asn (N), Gln (O), Asp (D), Lys (K) and Arg (R).

"Acidic Amino Acid or Residue" refers to a hydrophilic amino acid or residue having a side chain exhibiting a pK value of less than about 6 when the amino acid is included in a peptide or polypeptide. Acidic amino acids typically have negatively charged side chains at physiological pH due to loss of a hydrogen ion. Genetically encoded acidic amino acids include Glu (E) and Asp (D).

"Basic Amino Acid or Residue" refers to a hydrophilic amino acid or residue having a side chain exhibiting a pK value of greater than about 6 when the amino acid is included in a peptide or polypeptide. Basic amino acids typically have positively charged side chains at physiological pH due to association with hydronium ion. Genetically encoded basic amino acids include Arg (R) and Lys (K).

"Polar Amino Acid or Residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include Asn (N), Gln (O), Ser (S) and Thr (T).

"Hydrophobic Amino Acid or Residue" refers to an amino acid or residue having a side chain exhibiting a hydrophobicity of greater than zero according to the normalized consensus hydrophobicity scale of Eisenberg et al., 1984, *J. Mol. Biol.* 179:125-142. Genetically encoded hydrophobic amino acids include Pro (P), Ile (1), Phe (F), Val (V), Leu (L), Trp (W), Met (M), Ala (A) and Tyr (Y).

"Aromatic Amino Acid or Residue" refers to a hydrophilic or hydrophobic amino acid or residue having a side chain that includes at least one aromatic or heteroaromatic ring. Genetically encoded aromatic amino acids include Phe (F), Tyr (Y) and Trp (W). Although owing to the its heteroaromatic ring side chain His (H) is classified as an aromatic residue, it may also be classified as a basic residue owing to pKa of its heteroaromatic nitrogen atom.

"Non-polar Amino Acid or Residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include Gly (G), Leu (L), Val (V), Ile (I), Met (M) and Ala (A).

"Aliphatic Amino Acid or Residue" refers to a hydrophobic amino acid or residue having an aliphatic hydrocarbon side chain. Genetically encoded aliphatic amino acids include Ala (A), Val (V), Leu (L) and Ile (I).

The amino acid Cys (C) is unique in that it can form disulfide bridges with other Cys (C) amino acids or other sulfanyl- or sulfhydryl-containing amino acids. The ability of Cys (and other amino acids with —SH containing side chains) to exist in a polypeptide in either the reduced free —SH or oxidized disulfide-bridged form affects whether it contributes net hydrophobic or hydrophilic character to the polypeptide. While Cys exhibits a hydrophobicity of 0.29 according to the normalized consensus scale of Eisenberg (Eisenberg et al., 1984, supra), it is to be understood that for purposes of the present disclosure, Cys is classified into its own unique group.

The amino acid Pro (P) is conformationally constrained nature. Although it has hydrophobic properties, as used herein, Pro (P) or other similar residues is classified as a "conformationally constrained".

"Hydroxyl-containing Amino Acid or Residue" refers to an amino acid or residue containing a hydroxyl (—OH) moiety. Genetically-encoded hydroxyl-containing amino acids include Ser (S) and Thr (T). While L-Tyr (Y) contains a hydroxyl moiety, it is classified herein as an aromatic amino acid or residue.

"Amino acid difference" or "residue difference" refers to a change in the residue at a specified position of a polypeptide sequence when compared to a reference sequence. For example, a residue difference at position X3, where the reference sequence has a glutamine, refers to a change of the residue at position X3 to any residue other than glutamine. As disclosed herein, an enzyme can include one or more residue differences relative to a reference sequence, where multiple residue differences typically are indicated by a list of the specified positions where changes are made relative to the reference sequence.

"Conservative amino acid substitutions" refer to the interchangeability of residues having similar side chains, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acids having aromatic side chains is substituted with another amino acid having an aromatic side chain, e.g., phenylalanine, tyrosine, tryptophan, and histidine; an amino acid with a basic side chain is substituted with another amino acid with a basis side chain, e.g., lysine and arginine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively. Exemplary conservative substitutions are provided below:

| Residue | Possible Conservative Substitutions |
|---|---|
| A, L, V, I | Other aliphatic (A, L, V, I) |
|  | Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C | None |
| P | None |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification of the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the polypeptide while retaining enzymatic activity and/or retaining the improved properties of an engineered monooxygenase enzyme. Deletions can be directed to the internal portions and/or terminal portions of the polypeptide. In various embodiments, the deletion can comprise a continuous segment or can be discontinuous.

"Insertion" refers to modification of the polypeptide by addition of one or more amino acids to the reference polypeptide. In some embodiments, the improved engineered monooxygenase enzymes comprise insertions of one or more amino acids to the naturally occurring cyclohexanone monooxygenase polypeptide as well as insertions of one or more amino acids to other improved monooxygenase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can typically have about 80%, 90%, 95%, 98%, and 99% of the full-length monooxygenase polypeptide, for example the polypeptide of SEQ ID NO:2.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved monooxygenase enzymes may be present within a cell, present in the cellular medium, or prepared in various forms, such as lysates or isolated preparations. As such, in some embodiments, the improved monooxygenase enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure monooxygenase composition will comprise about 60% or more, about 70% or more, about 80% or more, about 90% or more, about 95% or more, and about 98% or more of all macromolecular species by mole or % weight present in the composition. Solvent species, small molecules (<500 Daltons), and elemental ion species are not considered macromolecular species. In some embodiments, the isolated improved monooxygenase polypeptide is a substantially pure polypeptide composition.

"Heterologous" polynucleotide refers to any polynucleotide that is introduced into a host cell by laboratory techniques, and includes polynucleotides that are removed from a host cell, subjected to laboratory manipulation, and then reintroduced into a host cell.

"Codon optimized" refers to changes in the codons of the polynucleotide encoding a protein to those preferentially used in a particular organism such that the encoded protein is efficiently expressed in the organism of interest. In some embodiments, the polynucleotides encoding the monooxygenase enzymes may be codon optimized for optimal production from the host organism selected for expression.

"Control sequence" is defined herein to include all components, which are necessary or advantageous for the expression of a polynucleotide and/or polypeptide of the present disclosure. Each control sequence may be native or foreign to the polynucleotide of interest. Such control sequences include, but are not limited to, a leader, polyadenylation sequence, propeptide sequence, promoter, signal peptide sequence, and transcription terminator.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Alkyl" by itself or as part of another substituent refers to a saturated or unsaturated branched, straight-chain or cyclic monovalent hydrocarbon radical having the stated number of carbon atoms (i.e., $C_1$-$C_6$ means one to six carbon atoms) that is derived by the removal of one hydrogen atom from a single carbon atom of a parent alkane, alkene or alkyne. The term "alkyl" is specifically intended to include groups having any degree or level of saturation, i.e., groups having exclusively single carbon-carbon bonds, groups having one or more double carbon-carbon bonds, groups having one or more triple carbon-carbon bonds and groups having mixtures of single, double and triple carbon-carbon bonds. Where a specific level of saturation is intended, the expressions "alkanyl," "alkenyl," and "alkynyl" are used. The expression "lower alkyl" refers to alkyl groups composed of from 1 to 6 carbon atoms ($C_1$-$C_6$), preferably 1-4 carbon atoms ($C_1$-$C_4$).

"Alkanyl" by itself or as part of another substituent refers to a saturated branched, straight-chain or cyclic alkyl derived by the removal of one hydrogen atom from a single carbon atom of a parent alkane. Alkanyl groups include, but are not limited to, methanyl; ethanyl; propanyls such as propan-1-yl, propan-2-yl (isopropyl), cyclopropan-1-yl, etc.; butanyls such as butan-1-yl, butan-2-yl (sec-butyl), 2-methyl-propan-1-yl (isobutyl), 2-methyl-propan-2-yl (1-butyl), cyclobutan-1-yl, etc.; and the like. In some embodiments, the alkanyl groups are ($C_1$-$C_6$) alkyl.

"Alkenyl" by itself or as part of another substituent refers to an unsaturated branched, straight-chain or cyclic alkyl having at least one carbon-carbon double bond derived by the removal of one hydrogen atom from a single carbon atom of a parent alkene. The group may be in either the cis or trans conformation about the double bond(s). In some embodiments, the alkenyl group is ($C_2$-$C_6$) alkenyl.

"Alkynyl" by itself or as part of another substituent refers to an unsaturated branched, straight-chain or cyclic alkyl having at least one carbon-carbon triple bond derived by the removal of one hydrogen atom from a single carbon atom of a parent alkyne. In some embodiments, the alkynyl group is ($C_2$-$C_6$) alkynyl.

"Alkoxy" by itself or as part of another substituent refers to —$OR^a$, where $R^a$ represents an alkyl or cycloalkyl group as defined herein. Typical alkoxy groups include, but are not limited to, methoxy, ethoxy, propoxy, butoxy, cyclohexyloxy, and the like.

"Amino" by itself or as part of another substituent refers to the group —$NH_2$. Substituted amino refers to the group —$NHR^b$, $NR^bR^b$, and $NR^bR^bR^b$ where each $R^b$ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylamino, triethylamino, methylsulfonylamino, furanyl-oxy-sulfamino, and the like.

"Heteroalkyl," Heteroalkanyl," Heteroalkenyl," and Heteroalkynyl," by themselves or as part of another substituent refer to alkyl, alkanyl, alkenyl, and alkynyl groups, respectively, in which one or more of the carbon atoms are each independently replaced with the same or different heteroatoms or heteroatom groups. Heteroatoms and/or heteroatom groups which can replace the carbon atoms include, but are not limited to, —O—, —S—, —S—O—, —$NR^c$—, —PH—, —S(O)—, —$S(O)_2$—, —S(O)NRS—, —$S(O)_2NR^c$—, and the like, including combinations thereof, where each $R^cC$ is independently hydrogen or ($C_1$-$C_6$) alkyl.

"Cycloalkyl" and "Heterocycloalkyl" by themselves or as part of another substituent refer to cyclic versions of "alkyl" and "heteroalkyl" groups, respectively. For heteroalkyl groups, a heteroatom can occupy the position that is attached to the remainder of the molecule. Typical cycloalkyl groups include, but are not limited to, cyclopropyl; cyclobutyls such as cyclobutanyl and cyclobutenyl; cyclopentyls such as cyclopentanyl and cyclopentenyl; cyclohexyls such as cyclohexanyl and cyclohexenyl; and the like. Typical heterocycloalkyl groups include, but are not limited to, tetrahydrofuranyl (e.g., tetrahydrofuran-2-yl, tetrahydrofuran-3-yl, etc.), piperidinyl (e.g., piperidin-1-yl, piperidin-2-yl, etc.), morpholinyl (e.g., morpholin-3-yl, morpholin-4-yl, etc.), piperazinyl (e.g., piperazin-1-yl, piperazin-2-yl, etc.), and the like.

"Aryl" by itself or as part of another substituent refers to a monovalent aromatic hydrocarbon group having the stated number of carbon atoms (i.e., $C_5$-$C_{15}$ means from 5 to 15 carbon atoms) derived by the removal of one hydrogen atom from a single carbon atom of a parent aromatic ring system. In some embodiments, the aryl group is ($C_5$-$C_{10}$) aryl, with ($C_5$-$C_8$) being even more preferred. In some embodiments, the aryls are cyclopentadienyl, phenyl and naphthyl.

"Heteroaryl" by itself or as part of another substituent refers to a monovalent heteroaromatic group having the stated number of ring atoms (e.g., "5-14 membered" means from 5 to 14 ring atoms) derived by the removal of one hydrogen atom from a single atom of a parent heteroaromatic ring system. In some embodiments, the heteroaryl group is a 5-10 membered heteroaryl. In some embodiments, the heteroaryl group is a 5-8 membered heteroaryl.

"Halogen" or "halo" by themselves or as part of another substituent, unless otherwise stated, refer to fluoro, chloro, bromo and iodo.

"Haloalkyl" by itself or as part of another substituent refers to an alkyl group in which one or more of the hydrogen atoms is replaced with a halogen. Thus, the term "haloalkyl" is meant to include monohaloalkyls, dihaloalkyls, trihaloalkyls, etc. up to perhaloalkyls. For example, the expression "($C_1$-$C_2$) haloalkyl" includes 1-fluoromethyl, difluoromethyl, trifluoromethyl, 1-fluoroethyl, 1,1-difluoroethyl, 1,2-difluoroethyl, 1,1,1-trifluoroethyl, perfluoroethyl, etc.

"Optionally substituted" as used herein means one or more hydrogen atoms (e.g., 1, 2, 3, 4, 5, or 6 hydrogen atoms) of the group can each be replaced with a substituent atom or group. Each substituent can be the same or different. Examples of suitable substituents include, but are not limited to, alkyl, alkenyl, alkynyl, cycloalkyl, aryl, aralkyl, cycloheteroalkyl, heteroaryl, OR$^d$ (e.g., hydroxyl, alkoxy (e.g., methoxy, ethoxy, and propoxy), aryloxy, heteroaryloxy, aralkyloxy, ether, ester, carbamate, etc.), hydroxyalkyl, alkoxycarbonyl, alkoxyalkoxy, perhaloalkyl, perfluoroalkyl (e.g., $CF_3$, $CF_2$, $CF_3$), perfluoroalkoxy (e.g., $OCF_3$, $OCF_2CF_3$), alkoxyalkyl, SR$^d$ (e.g., thiol, alkylthio, arylthio, heteroarylthio, aralkylthio, etc.), S(O)R$^d$, $SO_2R^dNR^dR^e$ (e.g., primary amine (i.e., $NH_2$), secondary amine, tertiary amine, amide, carbamate, urea, etc.), hydrazide, halide, nitrile, nitro, sulfide, sulfoxide, sulfone, sulfonamide, thiol, carboxy, aldehyde, keto, carboxylic acid, ester, amide, imine, and imide, including seleno and thio derivatives thereof, wherein each of the substituents can be optionally further substituted. In some embodiments, the number of optional substituents is 1 to 5, wherein the substituents are groups as defined herein. Preferably, 1-3 optional substituents can be present. In embodiments in which a functional group with an aromatic carbon ring is substituted, such substitutions will typically number less than about 10 substitutions, more preferably about 1 to 5, with about 1 to 3 substitutions being preferred. Generally, a substituent is selected that does not act as a substrate for the monooxygenases of the present disclosure.

"Substituted alkyl, cycloalkyl, heterocycloalkyl, aryl, or heteroaryl" refers to an alkyl, cycloalkyl, heterocycloalkyl, aryl, or heteroaryl group in which one or more hydrogen atoms is replaced with another substituent group.

5.2 DETAILED DESCRIPTION

Cyclohexanone monooxygenases (CHMO) were originally identified for their ability to carry out the conversion of cyclohexanone to epsilon-caprolactone, a seven membered cyclic product, as illustrated in the following reaction scheme:

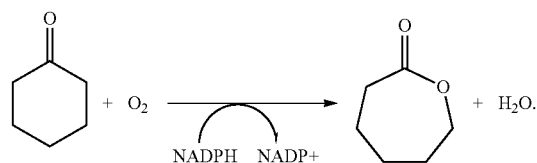

The biocatalytic reaction uses $O_2$ and a co-factor NAPDH to generate the caprolactone, oxidized cofactor NADP+, and $H_2O$. Cyclohexanone monooxygenases are flavin dependent enzymes and contain a flavin prosthetic group, generally flavin adenine dinucleotide (FAD). This FAD prosthetic group is bound to the enzyme and, without being bound by theory, believed to participate in the catalytic reaction by forming a peroxyflavin intermediate (see, e.g., Sheng et al., 2001, Biochemistry 40(37):11156-67; Malito et al., 2004, Pro. Natl Acad Sci USA 101(36):13157-13162).

Cyclohexanone monooxygenases have also been used as biocatalysts for the enantioselective air-oxidation of prochiral thioethers to form chiral sulfoxides (see, e.g., Light et al., 1982, Biochemistry, 21(10):2490-8). An example of this reaction using a cyclohexanone monooxygenase is described in Reetz et al., 2004, Angew. Chem. Int. Ed. 43:4078-4081:

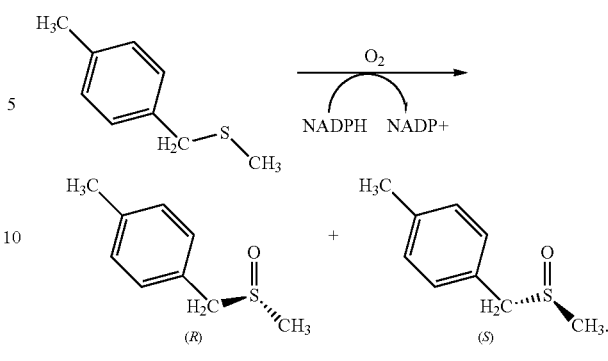

Cyclohexanone monooxygenases can recognize a variety of aryl-alkyl sulfide substrates, examples of which are described in Pasta et al., 1995, Tetrahedron: Asymmetry 6(4): 933-936; Yeung and Rettie, 2005, "Prochiral Sulfoxidation as a probe for Flavin-Containing Monooxygenases, In Methods in Molecular Biology: Cytochrome P950 Protocols 320:163-172; Colonna et al., 2000, Chirality 13(1):40-42; and Alphand et al., 2003, Trends Biotechnology 21(7):318-323.

Pyrmetazole, with the chemical name of 5-methoxy-2-((4-methoxy-3,5-dimethylpyridin-2-yl)methylthio)-1H-benzo [d]imidazole (also referred to herein as "compound (1)", is an intermediate in the synthesis of esomeprazole, with the chemical name of (S)-5-methoxy-2-((4-methoxy-3,5-dimethylpyridin-2-yl)methylsulfinyl)-1H-benzo[d]imidazole (also referred to herein as "compound (2b)"). As noted above, esomeprazole is the S-isomer of omeprazole, which is a racemic mixture containing the S and R isomers. Omeprazole and esomeprazole are inhibitors of $H^+K^+$ ATPases, which are proton transporters involved in the production of acid in the stomach. Omeprazole and esomeprazole are prescribed for the treatment of ulcers, gastroesophageal reflux disease, and Zollinger-Ellison syndrome. The current synthesis of esomeprazole involves a Kagan-Sharpless type chemical oxidation of sulfides to sulfoxides (see Cotton et al., 2000, Tetrahedron: Asymmetry 11: 3819). While biocatalytic oxidation of pyrmetazole mediated by cyclohexanone monooxygenases is described in U.S. Pat. No. 5,840,552, the process used whole cell preparations and resulted in low yield of product. In particular, preparations of Acinetobacter NCIMB9871 displayed lower activity toward pyrmetazole than preparations of other organisms.

In the present disclosure, engineered monooxygenase polypeptides have been designed starting from the cyclohexanone monooxygenase of Acinetobacter NCIMB9871 to efficiently oxidize pyrmetazole ("compound (1)") to the sulfoxide product ("compound (2)"). The naturally occurring cyclohexanone monooxygenase is inefficient in catalyzing this reaction. In some embodiments, the engineered polypeptides are further capable of enantioselectively converting pyrmetazole to either the (R) or (5) form of omeprazole in enantiomeric excess. In some embodiments, these engineered biocatalysts provide a highly efficient process for producing esomeprazole as substantially enantiomerically pure preparations. These engineered monooxygenase polypeptides can also be applied to the sulfoxidation of compounds structurally similar to pyrmetazole.

Accordingly, in some embodiments, the present disclosure provides polypeptides capable of converting compound (1) to compound (2), as illustrated in reaction Scheme 1 below, at a rate that is improved over the monooxygenase of SEQ ID NO:2:

Scheme 1

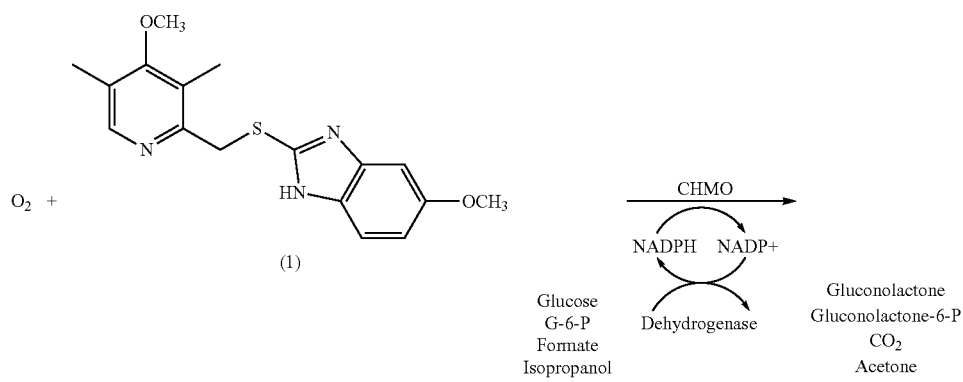

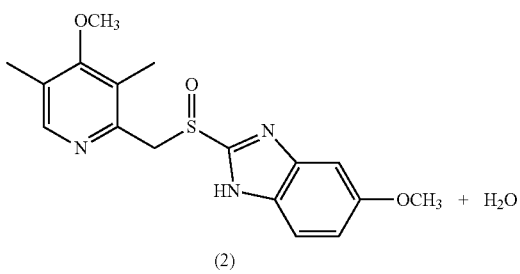

In some embodiments, the conversion rate of the engineered monooxygenase is greater than 1.5 fold the conversion rate of the monooxygenase of SEQ ID NO: 2.

Generally, the oxidation occurs in presence of molecular oxygen $O_2$ and an electron donor, such as cofactor NADPH or NADH. For purposes of comparing activities to a reference monooxygenase, such as SEQ ID NO:2, the cofactor NADPH is used. As further discussed below, the reaction can be carried out in presence of a co-factor regenerating system, for example an appropriate dehydrogenase (e.g., glucose dehydrogenase, formate dehydrogenase, phosphite dehydrogenase, or ketoreductase/alcohol dehydrogenase) and a suitable dehydrogenase substrate, such as glucose, glucose-6-phosphate, formate, phosphite, or an alcohol, e.g., isopropanol.

In some embodiments, the polypeptide is capable of converting compound (1) to compound (2) at a rate that is greater than 1.5 fold the rate of the monooxygenase polypeptide of SEQ ID NO:2 and comprises an amino acid sequence that is at least 80%, 85%, 86%, 87%, 88%, 89%, 90%, 91%, 92%, 93%, 94%, 95%, 96%, 97%, 98%, 99%, or more identical to a reference sequence selected from the group consisting of SEQ ID NO: 4, 6, 10, 22, 52, 76, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, and 266. In particular, the reference sequence is SEQ ID NO: 116, 124, 130, 138, or 158.

Some embodiments of the engineered monooxygenase polypeptides are capable of converting compound (1) to (R)-5-methoxy-2-((4-methoxy-3,5-dimethylpyridin-2-yl)methylsulfinyl)-1H-benzo[d]imidazole ("compound (2a)") in enantiomeric excess while other embodiments of the monooxygenase polypeptides are capable of converting compound (1) to (S)-5-methoxy-2-((4-methoxy-3,5-dimethylpyridin-2-yl)methylsulfinyl)-1H-benzo[d]imidazole ("compound (2b)") in enantiomeric excess. As will be apparent to the skilled artisan, the stereoselectivity of the engineered monooxygenases can be ascertained by using the substrate pyrmetazole and determining the amounts of (R) and (S) forms of the products produced. The stereoselectivity of the monooxygenases towards other prazole substrates can be determined in a similar manner.

In some embodiments, the polypeptides are capable of converting compound (1) to (R)-5-methoxy-2-((4-methoxy-3,5-dimethylpyridin-2-yl)methylsulfinyl)-1H-benzo[d]imidazole ("compound (2a)") in enantiomeric excess, as illustrated in the reaction Scheme 2 below:

Scheme 2

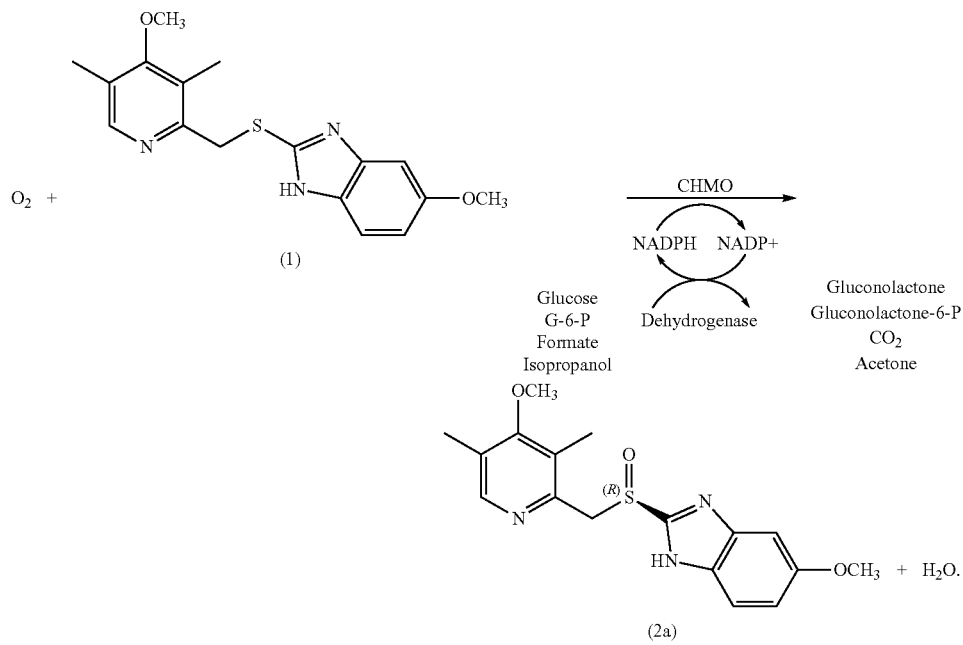

In some embodiments, the polypeptide capable of converting compound (1) to compound (2a) in enantiomeric excess comprises an amino acid sequence that is at least 80%, 85%, 86%, 87%, 88%, 89%, 90%, 91%, 92%, 93%, 94%, 95%, 96%, 97%, 98%, 99%, or more identical to a reference sequence selected from the group consisting of SEQ ID NO: 4, 6, 160, 162, 164, 166, 168, 170, 172, 174, 176, 178, 180, 182, 184, 186, 188, 190, 192, 194, 196, 198, 200, 202, 204, 206, and 208. In particular, the reference sequence is SEQ ID NO: 6, 166, 170, 174, 190, 192, 196, 200, 204, or 206.

In some embodiments, the polypeptide is capable of converting compound (1) to (S)-5-methoxy-2-((4-methoxy-3,5-dimethylpyridin-2-yl)methylsulfinyl)-1H-benzo[d]imidazole ("compound (2b)") in enantiomeric excess, as illustrated in the reaction Scheme 3 below:

Scheme 3

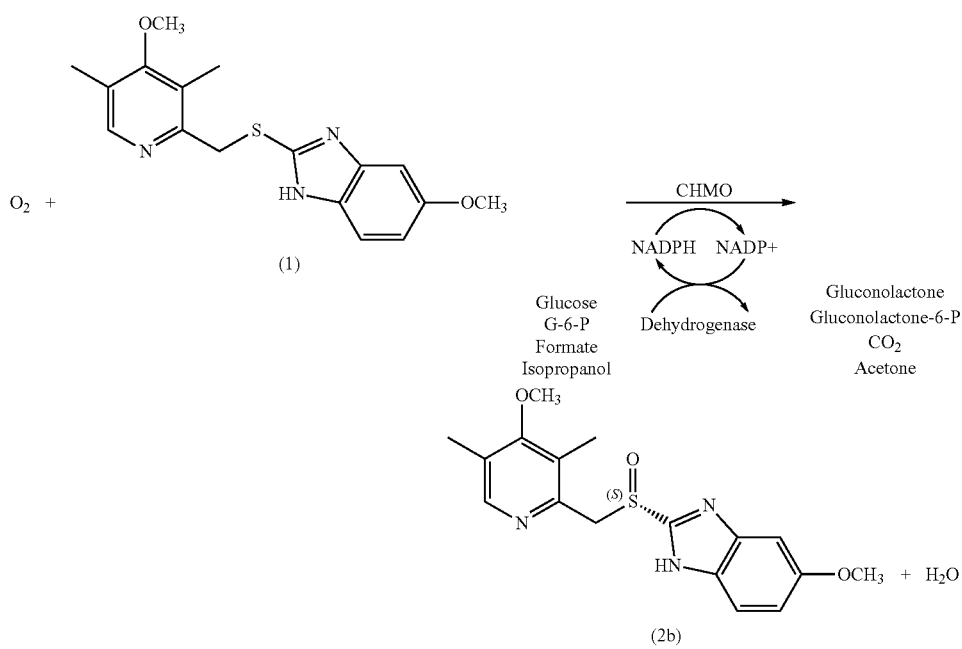

In some embodiments, the polypeptide capable of converting compound (1) to compound (2b) in enantiomeric excess comprises an amino acid sequence that is at least 80%, 85%, 86%, 87%, 88%, 89%, 90%, 91%, 92%, 93%, 94%, 95%, 96%, 97%, 98%, 99%, or more identical to a reference sequence selected from the group consisting of SEQ ID NO: 8, 10, 22, 52, 76, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266. In particular, the reference sequence is SEQ ID NO: 116, 124, 130, 138, or 158.

Since the wild type (WT) cyclohexanone monooxygenase of *Acinetobacter* sp NCIMB9871 does not efficiently convert pyrmetazole to the sulfoxide, the polypeptides presented herein comprise an amino acid sequence that has one or more residue differences as compared to the reference sequence of the naturally occurring cyclohexanone monooxygenase of *Acinetobacter* sp NCIMB9871 represented by SEQ ID NO:2. The residue differences can be non-conservative changes or conservative changes. In some embodiments, the residue differences can be conservative substitutions, non-conservative substitutions, or a combination of non-conservative and conservative substitutions. For the descriptions of the polypeptides herein, the amino acid residue position in the reference sequence is determined in the monooxygenase polypeptide beginning from the initiating methionine (M) residue (i.e., M represents residue position 1), although it will be understood by the skilled artisan that this initiating methionine residue may be removed by biological processing machinery, such as in a host cell or in vitro translation system, to generate a mature protein lacking the initiating methionine residue. The polypeptide sequence position at which a particular amino acid or amino acid change ("residue difference") is present is sometimes described herein as "Xn", or "position n", where n refers to the residue position with respect to the reference sequence.

Where applicable, a specific substitution mutation, which is a replacement of the specific residue in a reference sequence with a different specified residue may be denoted by the conventional notation "X(number)Y", where X is the single letter identifier of the residue in the reference sequence, "number" is the residue position in the reference sequence, and Y is the single letter identifier of the residue substitution in the engineered sequence.

In some embodiments, the residue differences as compared to SEQ ID NO:2 are present at one or more of the following residue positions: X3; X14; X34; X43; X71; X111; X141; X149, X174; X209; X240; X246; X248; X288; X307; X326; X383; X386; X388; X390; X400; X415; X426; X432; X433; X435; X438; X448; X449; X481; X488; X489; X490; X499; X505; X516; X526; X537; and X540. These residue positions are found to be associated with desirable changes in enzyme activity, enantioselectivity, sulfone-byproduct formation, thermostability, solvent stability, and/or protein expression. In some embodiments, the monooxygenase has at least two or more, at least three or more, or at least four or more residue differences at the residue positions above as compared to the reference sequence of SEQ ID NO:2.

Based on modeling studies of the cyclohexanone monooxygenase of *Acinetobacter* sp NCIMB9871 of SEQ ID NO:2, residue positions X14, X34, X43; X111, X141, X386, X388, X426, X432, X433, X435, and X438 are within 8 Å of the FAD prosthetic group on the enzyme; residue positions X149, X209, X277, X326, X426, X432, X435, X438, X488, X489, and X490 are within 8 Å of enzyme-bound NADPH cofactor; and residue positions X277, X326, X426, X432, X433, X435, X438, X489, X490, and X505 are within 8 Å of enzyme-bound pyrmetazole. While these residue positions are in close proximity to bound substrate, FAD prosthetic group, and co-factor, it has been found that the amino acid residues at these residue positions as well as the others above can be varied to alter specific enzyme properties, including, among others, substrate binding, enzyme activity, enantioselectivity, and thermostability.

In some embodiments, specifically excluded from the monooxygenase polypeptides of the disclosure are polypeptides having an amino acid sequence that contains the following mutation or set of mutations as compared to SEQ ID NO:2: D41N and F505Y; K78E and F432S; L143F; L220Q, P428S and T433A; F432S; F432I; L426P and A541V; F432Y and K500R; and L143F, E292G, L435Q, and T464A; D384H; K229I and L248P; Y132C, F246I, V361A, and T415A; and F16L and F277S. These monooxygenases are disclosed in Mihovilovic et al., 2006, Organic Lett. 8(6): 1221-1224; Reetz et al., 2004, Angew. Chem. Int. Ed. 43:4075-4078; and Reetz et al., 2004, Angew Chem. Int. Ed. 43:4078-4081; the contents of which are incorporated herein by reference.

In some embodiments, specifically excluded from the monooxygenase polypeptides of the disclosure are polypeptides having the amino acid sequence disclosed in the following UniProt databank accession numbers: (a) gi|81324523|sp|Q9F7E4|Q9F7E4_9GAMM Cyclohexanone monooxygenase; (b) gi|118066|sp|P12015.2|CYMO_ACISP RecName: Full=Cyclohexanone 1,2-monooxygenase; (c) gi|123163966|sp|Q11Z78|Q11Z78_POLSJ Flavin-containing monooxygenase FMO; (d) tr|A3U3H1|A3U3H1_9RHOB Flavin-containing monooxygenase FMO:FAD dependent oxidoreductase OS=*Oceanicola batsensis* HTCC2597 GN=OB2597_18631 PE=4 SV=1; (e) tr|A3T2M3|A3T2M3_9RHOB Flavin-containing monooxygenase FMO:FAD dependent oxidoreductase OS=*Sulfitobacter* sp. NAS-14.1 GN=NAS141_04678 PE=4 SV=1; and (f) tr|A1W7Q2|A1W7Q2_ACISJ Cyclohexanone monooxygenase OS=*Acidovorax* sp. (strain JS42) GN=Ajs_2102 PE=4 SV=1.

In some embodiments, the residue differences as compared to SEQ ID NO:2 at the specified residue positions can be selected from the following features: residue at position corresponding to X3 is a hydroxyl-containing amino acid residue; residue at position corresponding to X14 is an aliphatic amino acid residue; residue at position corresponding to X34 is a basic amino acid residue; residue at position corresponding to X43 is an aliphatic amino acid residue; residue at position corresponding to X71 is a non-polar amino acid residue; residue at position corresponding to X111 is a hydroxyl-containing amino acid residue; residue at position corresponding to X141 is an aliphatic amino acid residue; residue at position corresponding to X149 is an aliphatic or aromatic amino acid residue; residue at position corresponding to X174 is an aliphatic amino acid residue; residue at position corresponding to X209 is a constrained amino acid residue; residue at position corresponding to X240 is a basic amino acid residue; residue at position corresponding to X246 is an aromatic amino acid residue; residue at position corresponding to X248 is a cysteine (C), or an aliphatic, polar or hydroxyl-containing amino acid residue; residue at position corresponding to X288 is an aliphatic amino acid residue; residue at position corresponding to X307 is a basic amino acid residue; residue at position corresponding to X326 is a cysteine (C) or hydroxyl-containing amino acid residue; residue at position corresponding to X383 is an aliphatic amino acid residue; residue at position corresponding to X386 is a hydroxyl-containing amino acid residue; residue at position corresponding to X388 is a basic amino acid residue; residue at position corresponding to X390 is an aliphatic or basic amino acid residue; residue at position corresponding to X400 is an aliphatic amino acid residue; residue at position corresponding to X415 is an aliphatic amino acid residue; residue at position corresponding to X426 is an aromatic amino acid residue; residue at position corresponding to X432 is an aliphatic or hydroxyl-containing amino acid residue; residue at position corresponding to X433 is a non-polar or aliphatic amino acid residue; residue at position corresponding to X435 is a hydroxyl-containing amino acid residue; residue at position corresponding to X438 is an aliphatic amino acid residue; residue at position corresponding to X448 is an aromatic or aliphatic amino acid residue; residue at position corresponding to X449 is a non-polar, aliphatic or aromatic amino acid residue; residue at residue position corresponding to X481 is a basic amino acid residue; residue corresponding to X488 is a basic amino acid residue; residue at position corresponding to X489 is a cysteine (C); residue at position corresponding to X490 is a basic amino acid residue; residue at position corresponding to X499 is an aliphatic amino acid residue; residue at position corresponding to X505 is an aliphatic or aromatic amino acid residue; residue at position corresponding to X516 is an aliphatic amino acid residue; residue at position corresponding to X526 is an aliphatic amino acid residue; residue at position corresponding to X537 is a hydroxyl-containing residue; and residue at position corresponding to X540 is a polar or aliphatic amino acid residue. In some embodiments, where the amino acid residue of SEQ ID NO:2 at the corresponding residue position are encompassed within the category of amino acids described for the specified position, a different amino acid within that amino acid category can be used in light of the guidance provided herein.

In some embodiments, the residue differences as compared to SEQ ID NO:2 at the specified residue positions can be selected from the following features: residue at position corresponding to X3 is T; residue at position corresponding to X14 is A; residue at position corresponding to X34 is K; residue at position corresponding to X43 is G; residue at position corresponding to X71 is M; residue at position corresponding to X111 is T; residue at position corresponding to X141 is I or V; residue at position corresponding to X149 is V or W; residue at position corresponding to X174 is L or I; residue at position corresponding to X209 is P; residue at position corresponding to X240 is F or K; residue at position corresponding to X246 is E, H, Q, S, R, W, or Y; residue at position corresponding to X248 is C, I, N, V, or S; residue at position corresponding to X277 is L, M, or Q; residue at position corresponding to X278 is G, N, or S; residue at position corresponding to X280 is G, or R; residue at position corresponding to X281 is A, or S; residue at position corresponding to X282 is S; residue at position corresponding to X248 is C, N, V, or S; residue at position corresponding to X288 is I; residue at position corresponding to X307 is R; residue at position corresponding to X326 is C or T; residue at position corresponding to X383 is I or G; residue at position corresponding to X386 is S; residue at position corresponding to X388 is K; residue at position corresponding to X390 is R or I; residue at position corresponding to X400 is I; residue at position corresponding to X415 is A; residue at position corresponding to X426 is F; residue at position corresponding to X432 is A, C, D, H, I, K, L, S, T, or Y; residue at position corresponding to X433 is A, F, G, K, L, or W; residue at position corresponding to X435 is S or A; residue at position corresponding to X438 is I; residue at position corresponding to X448 is V or W; residue at position corresponding to X449 is M, F, or L; residue at position corresponding to X481 is K; residue at position corresponding to X488 is F, K, or L; residue at position corresponding to X489 is C; residue at position corresponding to X490 is R; residue at position corresponding to X499 is L; residue at position corresponding to X505 is W or L; residue at position corresponding to X516 is V; residue at position corresponding to X526 is V; residue at position corresponding to X537 is T; and residue corresponding to X540 is Q or A.

In some embodiments, the polypeptide comprises an amino acid sequence having one or more residue differences as compared to SEQ ID NO:2 at residue positions associated with increased enzyme activity, which positions are selected from the following: X14, X34, X43, X71, X111, X141, X149, X174, X209, X240, X246, X248, X277, X278, X280; X281; X282; X288, X307, X326, X341, X368, X386, X388, X390, X400, X415, X426, X432, X433, X435, X438, X448, X449, X481, X488, X489, X490, X499, X505, X516, X526, X537, and X540. In some embodiments, the polypeptide amino acid sequence has at least two or more residue differences, at least three or more residue differences, or at least four or more residue differences as compared to SEQ ID NO:2 at the residue positions associated with increased enzyme activity.

In some embodiments, the polypeptide comprises an amino acid sequence having one or more residue differences as compared to SEQ ID NO:2 at residue positions affecting enantioselectivity, which positions are selected from the following: X246; X248; X326; X386; X432; X433; X435; X438; and X448. In some embodiments, the polypeptide amino acid sequence has at least two or more residue differences, at least three or more residue differences, or at least four or more residue differences as compared to SEQ ID NO:2 at the residue positions associated with enantioselectivity.

In some embodiments, the polypeptide comprises an amino acid sequence having one or more residue differences as compared to SEQ ID NO:2 at residue positions associated with decreased amounts of sulfone-byproduct formation, where the sulfone-byproduct has the structure of compound (3) (shown above). Residue positions associated with decreased amounts of sulfone-byproduct of compound (3) are selected from the following: X246, X248, X277, and X438. The sulfone-byproduct of compound (3) is an undesirable product of the enzymatic reaction and is readily identified by its elution profile on a chromatographic column of 3,5-dimethylphenylcarbamate derivatized amylose immobilized on 5-μm silica (CHIRALPAK IA®). An exemplary solvent condition for resolution of the sulfone-byproduct from pyrmetazole and esomeprazole is 45:55 Heptane/EtOH, 1.0 mL/min, 40° C., with detection of eluent at 300 nm. In some embodiments, the polypeptides are capable of producing amounts of sulfone-byproduct of compound (3) that is decreased by 20% or more, 40% or more, or 90% or more than the amount produced by the polypeptide of SEQ ID NO:52 under the same assay conditions.

In some embodiments, the polypeptide capable of forming decreased amount of sulfone-byproduct of compound (3) as compared to the polypeptide of SEQ ID NO:52 comprises an amino acid sequence which includes one or more of the following features: residue at position corresponding to X246 is Y; residue at position corresponding to X248 is S; and residue at position corresponding to X438 is I.

In some embodiments, the polypeptide comprises an amino acid sequence having one or more residue differences as compared to SEQ ID NO:2 at residue positions associated with increased thermostability and/or solvent stability, which positions are selected from the following: X43, X71, X111, X149, X174, X307; X341, X368, X388, X390, X400, X449, X481, and X488. Thermostability can be determined by preincubating the polypeptide at a set of defined temperatures and times, e.g., 4° C.-50° C. for 18-24 hours, followed by measuring the % residual activity of the polypeptide using a defined assay. Thermostability can then be characterized as the temperature at which the variant retains 50% residual activity. In some embodiments, the thermostable polypeptides have at least 50% residual activity under the exemplary preincubation condition. Accordingly, in some embodiments the polypeptides of the disclosure exhibit an increased thermostability of retaining 50% residual activity following 18 hours preincubation at 30° C., 32° C., 34° C., 36° C., 38° C., 40° C., 42° C., 44° C., 46° C., 48° C., 50° C., 52° C., or even higher temperatures. Thermostability can also be characterized as the activity FIOP when the activity assay is carried out at an elevated temperature, e.g., FIOP activity at 32° C. Accordingly, in some embodiments the polypeptides of the disclosure exhibit an increased thermostability as determined by an increase in activity FIOP at an elevated temperature 30° C., 32° C., 34° C., 36° C., 38° C., 40° C., 42° C., 44° C., 46° C., 48° C., 50° C., 52° C., or even higher temperatures. Similarly, solvent stability can be determined by preincubating the polypeptide in a defined solvent at a defined temperature and time, and measuring the % residual activity of the polypeptide using a defined assay.

In some embodiments, the polypeptide with increased thermostability as compared to the polypeptide of SEQ ID NO: 6 comprises an amino acid sequence which includes one or more of the following features: residue at position corresponding to X43 is G; residue at position corresponding to X71 is M; residue at position corresponding to X111 is T; residue at position corresponding to X149 is V or W; residue at position corresponding to X174 is L or I, residue at position corresponding to X307 is R; residue at position corresponding to X341 is E; residue at position corresponding to X368 is N or V; residue at position corresponding to X388 is K; residue at position corresponding to X390 is R; residue at position corresponding to X400 is I; residue at position corresponding to X449 is M, F or L; residue at position corresponding to X481 is K; and residue at position corresponding to X488 is K.

In some embodiments, the polypeptide comprises an amino acid sequence having residue differences as compared to SEQ ID NO:2 at residue positions associated with increased protein expression, which positions include X3. In particular, the residue at position corresponding to X3 is T.

In addition to the residue positions above that affect enzyme activity, enantioselectivity, sulfone-byproduct formation, thermostability, solvent stability, and/or expression, the polypeptide can have additional residue differences as compared to SEQ ID NO:2 at other residue positions. Residue differences at these residue other positions provide for additional variations in the amino acid sequence without adversely affecting the ability of the polypeptide to carry out the conversion of compound (1) to compound (2), in particular the conversion to compound (2b) in enantiomeric excess. In some embodiments, the polypeptide can comprise an amino acid sequence which includes in addition to the features above for the specified residue positions, one or more of the following features: residue at position corresponding to X15 is an aliphatic amino acid residue; residue at position corresponding to X22 is an aliphatic amino acid residue; residue at position corresponding to X32 is a polar amino acid residue; residue at position corresponding to X39 is an aliphatic amino acid residue; residue at position corresponding to X44 is an acidic amino acid residue; residue at position corresponding to X59 is an constrained amino acid residue; residue at position corresponding to X74 is an aliphatic amino acid residue; residue at position corresponding to X83 is an acidic amino acid residue; residue at position corresponding to X92 is a polar amino acid residue; residue at position corresponding to X107 is a basic amino acid residue; residue at position corresponding to X114 is a basic amino acid residue; residue at position corresponding to X123 is an acidic amino acid residue; residue at position corresponding to X146 is a hydroxyl-containing or aliphatic amino acid residue; residue at position corresponding to X155 is a nonpolar amino acid residue; residue at position corresponding to X161 is an aliphatic or an acidic amino acid residue; residue at position corresponding to X176 is an acidic amino acid residue; residue at position corresponding to X194 is a hydroxyl-containing amino acid residue; residue at position corresponding to X195 is an aliphatic amino acid residue; residue at position corresponding to X199 is a constrained amino acid residue; residue at position corresponding to X201 is a polar amino acid residue; residue at position corresponding to X244 is an aliphatic amino acid residue; residue at position corresponding to X245 is an aliphatic amino acid residue; residue at position corresponding to X329 is a polar amino acid residue; residue at position corresponding to X330 is hydroxyl-containing or aliphatic amino acid residue; residue at position corresponding to X354 is an aliphatic amino acid residue; residue at position corresponding to X367 is an acidic amino acid residue; residue at position corresponding to X368 is a polar or aliphatic amino acid residue; residue at position corresponding to X408 is an aliphatic amino acid residue; residue at position corresponding to X428 is an aliphatic amino acid residue; residue at position corresponding to X451 is a basic amino acid residue; residue at position corresponding to X454 is an aliphatic amino acid residue; residue at position corresponding to X459 is a basic amino acid residue; residue at position corresponding to X475 is an aliphatic amino acid residue; residue at position corresponding to X507 is an aromatic amino acid residue; and residue at position corresponding to X532 is a constrained amino acid residue. As noted above, in some embodiments, where the amino acid residue of SEQ ID NO:2 at the corresponding residue position is encompassed within the category of amino acids described for the specified positions of the engineered polypeptides, a different amino acid within that amino acid category can be used in light of the guidance provided herein. Without being bound by theory, the influence of these residue positions on enzyme function is provided in Table 3.

In some embodiments, the polypeptide amino acid sequence can have for the specified residue positions, one or more of the following features: residue at position corresponding to X15 is A; residue at position corresponding to X22 is A; residue at position corresponding to X32 is N; residue at position corresponding to X38 is E; residue at position corresponding to X39 is G; residue at position corresponding to X44 is E; residue at position corresponding to X59 is P; residue at position corresponding to X64R; residue at position corresponding to X74 is G; residue at position corresponding to X83 is E; residue at position corresponding to X92 is N; residue at position corresponding to X107 is K; residue at position corresponding to X114 is R; residue at position corresponding to is D; residue at position corresponding to X143 is N or V; residue at position corresponding to X144 is A; residue at position corresponding to X146 is T or V; residue at position corresponding to X149 is F, M, V, or W; residue at position corresponding to X155 is M; residue at position corresponding to X161 is A, V or D; residue at position corresponding to X176 is D; residue at position corresponding to X194 is E or S; residue at position corresponding to X195 is G; residue at position corresponding to X199 is P; residue at position corresponding to X201 is N; residue at position corresponding to X244 is V; residue at position corresponding to X245 is G; residue at position corresponding to X272 is R; residue at position corresponding to X312 is Q; residue at position corresponding to X329 is N; residue at position corresponding to X330 is S or G; residue at position corresponding to X354 is A; residue at position corresponding to X367 is E; residue at position corresponding to X368 is N or V; residue at position corresponding to X373 is L; residue at position corresponding to X377 is G; residue at position corresponding to X406 is D; residue at position corresponding to X408 is A; residue at position corresponding to X428 is L; residue at position corresponding to X451 is R; residue at position corresponding to X454 is I; residue at position corresponding to X459 is K; residue at position corresponding to X464 is D; residue at position corresponding to X475 is A; residue at position corresponding to X480N; residue at position corresponding to X499 is G or R; residue at position corresponding to X507 is F; residue at position corresponding to X512 is N; residue at position corresponding to X532 is P; and residue at position corresponding to X541 is G.

As will be understood by the skilled artisan, the monooxygenase polypeptide can have additional residue differences as compared to SEQ ID NO:2 at residue positions other than those specified above. In some embodiments, the polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40 residue differences at other amino acid residue positions as compared to the reference sequence. In some embodiments, the number of differences can be 1, 2, 3, 4, 5, 6, 7, 8, 9, 10, 11, 12, 14, 15, 16, 18, 20, 22, 24, 26, 30, 35, and 40 residue differences at other residue positions. The residue difference at these other positions can include conservative changes or non-conservative changes. In some embodiments, the residue differences can comprise conservative substitutions and non-conservative substitutions as compared to the monooxygenase of SEQ ID NO:2. In some embodiments, the other residue differences comprise conservative substitutions.

Various combinations of amino acid residue differences as compared to SEQ ID NO:2 at the residue positions defined above can be used to form the polypeptides with the desired characteristics. As will be apparent to the skilled artisan, some residue positions can have effects on more than one enzyme property, and therefore can be used to affect more than one enzyme property. For example, residues affecting enzyme activity and enantioselectivity can be used in combination to form polypeptides with increased enzymatic activity and enantioselectivity for the conversion of compound (1) to compound (2b), or increased enzymatic activity and enantioselectivity for the conversion of compound (1) to compound (2a). Additionally, residue positions associated with increased thermostability, increased solvent stability, decreased sulfone-byproduct formation, and increased protein expression, can be added to effect changes in the polypeptide with respect to such properties.

In view of the above, in some embodiments, a polypeptide capable of converting compound (1) to compound (2a) in enantiomeric excess at a rate that is greater than 1.5 fold the rate of the monooxygenase of SEQ ID NO:2 can comprise an amino acid sequence which includes at least two or more of the following features: residue at position corresponding to X432 is an aliphatic or hydroxyl-containing amino acid residue; residue at position corresponding to X433 is a non-polar or aliphatic amino acid residue; residue at position corresponding to X435 is a hydroxyl-containing or aliphatic amino acid residue; and residue at position corresponding to X490 is a basic amino acid residue. In some embodiments, the R-enantioselective monooxygenases have at least three or more of the above features, or at least all of the above features.

In some embodiments, the polypeptide capable of converting compound (1) to compound (2a) in enantiomeric excess at a rate that is greater than 1.5 fold the rate of the monooxygenase of SEQ ID NO:2 can comprise an amino acid sequence which includes at least two or more of the following features: residue at position corresponding to X432 is A, C, D, H, K, I, S, T, or Y; residue at position corresponding to X433 is A, F, G, K, or W; residue at position corresponding to X435 is A or S; and residue at position corresponding to X490 is E, P, or R. In some embodiments, the R-enantioselective monooxygenase has an amino acid sequence that has at least three or more of the above features, or at least all of the above features.

In some embodiments of the R-enantioselective polypeptides, residue differences at other residue positions associated with desirable changes in other enzyme properties, such as enzyme activity, sulfone-byproduct formation, thermostability, solvent stability and/or protein expression can be present.

In some embodiments of the R-enantioselective polypeptides, the polypeptide amino acid sequence can, in addition to the features above features, further include one or more of the following features: residue at position corresponding to X326 is a hydroxyl-containing residue; residue at position corresponding to X329 is a polar residue; residue at position corresponding to X383 is an aliphatic amino acid residue; and residue at position corresponding to X451 is a basic amino acid residue. In some embodiments, amino acid residues at the residue positions are selected from the following: residue at position corresponding to X277 is V; residue at position corresponding to X278 is H; residue at position corresponding to X279 is Y; residue at position corresponding to X280 is W; residue at position corresponding to X281 is H; residue at position corresponding to X326 is A, D, L, S, or T; residue at position corresponding to X329 is N; residue at position corresponding to X383 is I; residue at position corresponding to X426 is H, or Q; residue at position corresponding to X451 is R; and residue at position corresponding to X489 is P.

In some embodiments, the polypeptide capable of converting compound (1) to compound (2a) in enantiomeric excess comprises an amino acid sequence which includes at least the following features: residue at position corresponding to X432 is A; residue at position corresponding to X433 is A; residue at position corresponding to X435 is S; and residue at position corresponding to X490 is R. In such embodiments, the polypeptide capable of converting compound (1) to compound (2a) can further comprise one or more of the following features: residue at position corresponding to X277 is V; residue at position corresponding to X278 is H; residue at position corresponding to X279 is Y; residue at position corresponding to X280 is W; residue at position corresponding to X281 is H; residue at position corresponding to X326 is A, D, L, S, or T; residue at position corresponding to X329 is N; residue at position corresponding to X383 is I; residue at position corresponding to X426 is H, or Q; residue at position corresponding to X451 is R; and residue at position corresponding to X489 is P.

In some embodiments, the polypeptide capable of converting compound (1) to compound (2a) in enantiomeric excess comprises an amino acid sequence which includes at least the following features: residue at position corresponding to X326 is T; residue at position corresponding to X329 is N; residue at position corresponding to X383 is I; residue at position corresponding to X432 is S; residue at position corresponding to X433 is G; residue at position corresponding to X435 is S; residue at position corresponding to X451 is R; and residue at position corresponding to X490 is R. In such embodiments, the polypeptide capable of converting compound (1) to compound (2a) can further comprise one or more of the following features: residue at position corresponding to X277 is V; residue at position corresponding to X278 is H; residue at position corresponding to X279 is Y; residue at position corresponding to X280 is W; residue at position corresponding to X281 is H; residue at position corresponding to X326 is A, D, L, S, or T; residue at position corresponding to X329 is N; residue at position corresponding to X383 is I; residue at position corresponding to X426 is H, or Q; residue at position corresponding to X451 is R; and residue at position corresponding to X489 is P.

In addition to the residue positions above, the R-enantioselective polypeptide can have additional residue differences as compared to SEQ ID NO:2 at other residue positions. In some embodiments, the R-enantioselective polypeptides can have additionally 1-2, 1-3, 1-4, 1-5, 1-6, 1-7, 1-8,1-9, 1-10, 1-11, 1-12, 1-14, 1-15, 1-16, 1-18, 1-20, 1-22, 1-24, 1-26, 1-30, 1-35, 1-40 residue differences at other amino acid residue positions as compared to the reference sequence. In some embodiments, the number of differences can be 1, 2, 3, 4, 5, 6, 7, 8, 9, 10, 11, 12, 14, 15, 16, 18, 20, 22, 24, 26, 30, 35, and 40 residue differences at other residue positions. The residue difference at these other positions can include conservative changes or non-conservative changes. In some embodiments, the residue differences can comprise conservative substitutions and non-conservative substitutions as compared to the monooxygenase of SEQ ID NO:2. In some embodiments, these other residue differences comprise conservative substitutions.

As noted above, some embodiments of the monooxygenases disclosed herein are capable of converting compound (1) to compound (2b) in enantiomeric excess. In some embodiments, these compound (2b) enantioselective monooxygenases comprise an amino acid sequence having residue differences at residue positions associated with S-enantioselectivity, particularly at residue positions corresponding to X326 and X386.

In some embodiments, the polypeptide capable of converting compound (1) to compound (2b) in enantiomeric excess comprises an amino acid sequence in which at least residue at position corresponding to X326 is a cysteine (C).

In some embodiments, the polypeptide capable of converting compound (1) to compound (2b) in enantiomeric excess comprises an amino acid sequence in which at least residue at position corresponding to X386 is a hydroxyl-containing amino acid residue, particularly a S.

In some embodiments, the polypeptide capable of converting compound (1) to compound (2b) in enantiomeric excess comprises an amino acid sequence in which in which at least residue at position corresponding to X326 is a cysteine (C) and residue at position corresponding to X386 is a hydroxyl-containing amino acid residue, particularly a S.

In some embodiments, the S-enantioselective monooxygenase polypeptide comprises an amino acid sequence having, in addition to residue differences associated with S-enantioselectivity above, at least one or more residue differences at residue positions associated with increases in enzyme activity for the pyrmetazole substrate and/or further increases in S-enantioselectivity, particularly at residue positions X432, X433, X435, X438, X448, and X490; and more particularly at least one or more residue differences at residue positions X432, X433, X435, and X490.

In some embodiments, the polypeptide capable of converting compound (1) to compound (2b) in enantiomeric excess comprises an amino acid sequence which includes at least the following features: residue at position corresponding to X326 is a cysteine (C); residue at position corresponding to X386 is a hydroxyl-containing amino acid residue; and residue at position corresponding to X432 is an aliphatic or hydroxyl-containing amino acid residue.

In some embodiments, the polypeptide capable of converting compound (1) to compound (2b) in enantiomeric excess comprises an amino acid sequence which includes at least the following features: residue at position corresponding to X326 is C; residue at position corresponding to X386 is S; and residue at position corresponding to X432 is A, or L.

In some embodiments of the S-enantioselective monooxygenases, in addition to the features above at positions X326, X386, and X432, the polypeptide amino acid sequence can further include one or more of the following features: residue at position corresponding to X433 is an aliphatic amino acid residue; residue at position corresponding to X435 is a hydroxyl-containing amino acid residue; residue at position corresponding to X438 is an aliphatic amino acid residue; residue at position corresponding to X448 is an aliphatic or aromatic amino acid residue; and residue at position corresponding to X490 is a basic amino acid residue. In some embodiments of the S-enantioselective monooxygenase, the amino acid residues at the residue positions associated with enzymatic activity can be selected from the following: residue at position corresponding to X433 is A, L, or V; residue at position corresponding to X435 is S; residue at position corresponding to X438 is I; residue at position corresponding to X448 is V or W; and residue at position corresponding to X490 is R.

In some embodiments, the polypeptide capable of converting compound (1) to compound (2b) in enantiomeric excess comprises amino acid sequence which includes at least the following features: residue at position corresponding to X326 is a cysteine (C); residue at position corresponding to X386 is a hydroxyl-containing amino acid residue; residue at position corresponding to X432 is an aliphatic or hydroxyl-containing amino acid residue; residue at position corresponding to X433 is an aliphatic amino acid residue, residue at position corresponding to X435 is a hydroxyl-containing amino acid residue; and residue at position corresponding to X490 is a basic amino acid residue.

In some embodiments, the polypeptide capable of converting compound (1) to compound (2b) in enantiomeric excess comprises an amino acid sequence which includes at least the following features: residue at position corresponding to X326 is C; residue at position corresponding to X386 is S; residue at position corresponding to X432 is A, or L; residue at position corresponding to X433 is A, L, or V; residue at position corresponding to X435 is S; and residue at position corresponding to X490 is R.

As noted above, residue differences as compared to SEQ ID NO:2 at other residue positions associated with desirable changes in enzyme activity, enantioselectivity, sulfone-byproduct formation, thermostability, solvent stability, and expression can be used in combination with the features at the specific residue positions described above to form polypeptides with additional improvements in the biocatalytic conversion of compound (1) to compound (2b), or in some embodiments, the biocatalytic conversion of compound (1) to compound (2a). In some embodiments, the polypeptide amino acid sequence can include, in addition to the above features, one or more of the following features: residue at position corresponding to X3 is a hydroxyl-containing amino acid residue; residue at position corresponding to X14 is an aliphatic amino acid residue; residue at position corresponding to X34 is a basic amino acid residue; residue at position corresponding to X43 is an aliphatic amino acid residue; residue at position corresponding to X71 is a non-polar amino acid residue; residue at position corresponding to X83 is a an acidic amino acid residue; residue at position corresponding to X111 is a hydroxyl-containing amino acid residue; residue at position corresponding to X141 is an aliphatic amino acid residue; residue at position corresponding to X149 is an aliphatic or aromatic amino acid residue; residue at position corresponding to X174 is an aliphatic amino acid residue; residue at position corresponding to X209 is a constrained amino acid residue; residue at position corresponding to X240 is an aromatic or a basic amino acid residue; residue at position corresponding to X246 is an aromatic amino acid residue; residue at position corresponding to X248 is a cysteine (C), or an aliphatic, polar, or hydroxyl-containing amino acid residue; residue at position corresponding to X288 is an aliphatic amino acid residue; residue at position corresponding to X307 is a cysteine (C) or a basic amino acid residue; residue at position corresponding to X341 is an acidic amino acid residue; residue at position corresponding to X388 is a basic amino acid residue; residue at position corresponding to X390 is an aliphatic or basic amino acid residue; residue at position corresponding to X400 is an aliphatic amino acid residue; residue at position corresponding to X415 is an aliphatic amino acid residue; residue at position corresponding to X426 is an aromatic amino acid residue; residue at position corresponding to X449 is a non-polar or aromatic amino acid residue; residue at position corresponding to X449 is an acidic residue; residue at position corresponding to X481 is a basic amino acid residue; residue at position corresponding to X488 is a basic amino acid residue; residue at position corresponding to X489 is a cysteine (C); residue at position corresponding to X499 is an aliphatic amino acid residue; residue at position corresponding to X505 is an aliphatic or aromatic amino acid residue; residue at position corresponding to X516 is an aliphatic amino acid residue; residue at position corresponding to X526 is an aliphatic amino acid residue; residue at position corresponding to X537 is a hydroxyl-containing residue; and residue at position corresponding to X540 is a polar or aliphatic amino acid residue.

In some embodiments, the polypeptide amino acid sequence can include at one or more of the specified residue positions the following features: residue at position corresponding to X3 is T; residue at position corresponding to X14 is A; residue at position corresponding to X34 is K; residue at position corresponding to X43 is G; residue at position corresponding to X71 is M; residue at position corresponding to X83 is E; residue at position corresponding to X111 is T; residue at position corresponding to X141 is I or V; residue at position corresponding to X149 is V or W; residue at position corresponding to X174 is L or I; residue at position corresponding to X209 is P; residue at position corresponding to X240 is F or K; residue at position corresponding to X246 is E, H, Q, S, R, W, or Y; residue at position corresponding to X248 is C, I, N, V, or S; residue at position corresponding to X277 is L, M, or Q; residue at position corresponding to X278 is G, N, or S; residue at position corresponding to X280 is G, or R; residue at position corresponding to X281 is A, or S; residue at position corresponding to X282 is S; residue at position corresponding to X288 is I; residue at position corresponding to X307 is C or R; residue at position corresponding to X341 is E; residue at position corresponding to X373 is L; residue at position corresponding to X377 is G; residue at position corresponding to X388 is K; residue at position corresponding to X390 is R or 1; residue at position corresponding to X400 is I; residue at position corresponding to X415 is A; residue at position corresponding to X426 is F; residue at position corresponding to X449 is M, F, or L; residue at position corresponding to X464 is D; residue at position corresponding to X481 is K; residue at position corresponding to X488 is F, K, or L; residue at position corresponding to X489 is a C; residue at position corresponding to X499 is L; residue at position corresponding to X505 is W or L; residue at position corresponding to X516 is V; residue at position corresponding to X526 is V; residue at position corresponding to X537 is T; and residue at position corresponding to X540 is Q or A.

As noted above, in some embodiments, the polypeptide capable of converting compound (1) to compound (2b) in enantiomeric excess, or in some embodiments, capable of converting compound (1) to compound (2a) in enantiomeric excess can comprise an amino acid sequence which includes, in addition to the features above for the specified residue positions, residue differences at one or more of the following positions: X15; X22; X32; X38; X39; X44; X59; X64; X74; X92; X107; X114; X123; X143; X144; X146; X149; X155; X161; X176; X194; X195; X199; X201; X244; X245; X246; X272; X278; X279; X280; X281; X282; X312; X329; X330; X341; X354; X367; X368; X406; X408; X428; X451; X454; X459; X464; X475; X480; X499; X507; X512; X532; and X541.

The amino acid residues that can be used at these additional residue positions are described above. In some embodiments, where the amino acid residue of SEQ ID NO:2 at the corresponding residue position are encompassed within the category of amino acids described for the specified positions of the engineered polypeptides, a different amino acid within that amino acid category can be used in light of the guidance provided herein.

Thus, in some embodiments, the polypeptide capable of converting compound (1) to compound (2) can comprise an amino acid sequence which includes at least the following features: residue at position corresponding to X34 is K; residue at position corresponding to X209 is P; residue at position corresponding to X240 is K; residue at position corresponding to X288 is I; residue at position corresponding to X326 is C; residue at position corresponding to X386 is S; residue at position corresponding to X415 is A; residue at position corresponding to X432 is L; residue at position corresponding to X433 is A, residue at position corresponding to X435 is S; residue at position corresponding to X438 is I; residue at position corresponding to X448 is V; residue at position corresponding to X490 is R; residue at position corresponding to X516 is V; and residue at position corresponding to X537 is T.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X141 is V; residue at position corresponding to X209 is P; residue at position corresponding to X240 is K; residue at position corresponding to X288 is I; residue at position corresponding to X326 is C; residue at position corresponding to X386 is S; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X489 is C; residue at position corresponding to X490 is R; residue at position corresponding to X516 is V; and residue at position corresponding to X537 is T.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X111 is T; residue at position corresponding to X141 is V; residue at position corresponding to X209 is P; residue at position corresponding to X240 is K; residue at position corresponding to X246 is Y; residue at position corresponding to X288 is I; residue at position corresponding to X307 is R; residue at position corresponding to X326 is C; residue at position corresponding to X386 is S; residue at position corresponding to X388 is K; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X481 is K; residue at position corresponding to X489 is C; residue at position corresponding to X490 is R; residue at position corresponding to X505 is L; residue at position corresponding to X516 is V; and residue at position corresponding to X537 is T.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X43 is G; residue at position corresponding to X71 is M; residue at position corresponding to X111 is T; residue at position corresponding to X141 is V; residue at position corresponding to X149 is W; residue at position corresponding to X209 is P; residue at position corresponding to X240 is K; residue at position corresponding to X246 is Y; residue at position corresponding to X248 is V; residue at position corresponding to X277 is M; residue at position corresponding to X288 is I; residue at position corresponding to X307 is R; residue at position corresponding to X326 is C; residue at position corresponding to X341 is E; residue at position corresponding to X386 is S; residue at position corresponding to X388 is K; residue at position corresponding to X390 is I; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X464 is D; residue at position corresponding to X481 is K; residue at position corresponding to X489 is C; residue at position corresponding to X490 is R; residue at position corresponding to X499 is L; residue at position corresponding to X505 is L; residue at position corresponding to X516 is V; residue at position corresponding to X526 is V; residue at position corresponding to X537 is T; and residue at position corresponding to X540 is Q.

In some embodiments, the polypeptide capable of converting compound (1) to compound (2b) in enantiomeric excess comprises an amino acid sequence which includes at least the following features: residue at position corresponding to X14 is A; residue at position corresponding to X34 is K; residue at position corresponding to X43 is G; residue at position corresponding to X71 is M; residue at position corresponding to X83 is E; residue at position corresponding to X111 is T; residue at position corresponding to X141 is V; residue at position corresponding to X149 is W; residue at position corresponding to X174 is I; residue at position corresponding to X209 is P; residue at position corresponding to X240 is F or K; residue at position corresponding to X246 is Y; residue at position corresponding to X248 is I or V; residue at position corresponding to X277 is M; residue at position corresponding to X288 is I; residue at position corresponding to X307 is C or R; residue at position corresponding to X326 is C; residue at position corresponding to X341 is E; residue at position corresponding to X373 is L; residue at position corresponding to X377 is G; residue at position corresponding to X383 is G; residue at position corresponding to X386 is S; residue at position corresponding to X388 is K; residue at position corresponding to X390 is I; residue at position corresponding to X400 is I; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X449 is F; residue at position corresponding to X464 is D; residue at position corresponding to X481 is K; residue at position corresponding to X488 is K; residue at position corresponding to X489 is C; residue at position corresponding to X490 is R; residue at position corresponding to X499 is L; residue at position corresponding to X505 is L; residue at position corresponding to X516 is V; residue at position corresponding to X526 is V; residue at position corresponding to X537 is T; and residue at position corresponding to X540 is Q.

In some embodiments, the above polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40 residue differences at other amino acid residue positions as compared to the reference sequence. In some embodiments, the number of differences can be 1, 2, 3, 4, 5, 6, 7, 8, 9, 10, 11, 12, 14, 15, 16, 18, 20, 22, 24, 26, 30, 35, and 40 residue differences at other residue positions. The residue difference at these other positions can include conservative changes or non-conservative changes. In some embodiments, the residue differences can comprise conservative substitutions and non-conservative substitutions as compared to the monooxygenase of SEQ ID NO:2. In some embodiments, the residue differences comprise conservative substitutions.

In some embodiments, the polypeptide capable of forming compound (2b) in enantiomeric excess comprises an amino acid sequence selected from the group consisting of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266.

In some embodiments, the polypeptide is capable of converting compound (1) to compound (2b) in at least 90% enantiomeric excess. In some embodiments, the polypeptide is capable of forming compound (2b) in at least 91%, 92%, 93%, 94%, 95%, 96%, 97%, 98%, or 99% or more enantiomeric excess.

In some embodiments, the polypeptide capable of forming compound (2b) in at least 90% enantiomeric excess comprises an amino acid sequence which includes at least one or more, at least two or more, at least three or more, or at least four or more of the following features: residue at position corresponding to X246 is Y; residue at position corresponding to X248 is S; residue at position corresponding to X326 is C; residue at position corresponding to X386 is S; residue at position corresponding to X432 is L; residue at position corresponding to X433 is A; residue at position corresponding to X435 is S; residue at position corresponding to X438 is I; and residue at position corresponding to X448 is V.

In some embodiments, the polypeptide capable of forming compound (2b) in at least 90% enantiomeric excess comprises an amino acid sequence which includes at least the following features: residue at position corresponding to X326 is C; residue at position corresponding to X386 is S; residue at position corresponding to X438 is I; and residue at position corresponding to X448 is V.

In some embodiments, the polypeptide capable of forming compound (2b) in at least 90% enantiomeric excess comprises an amino acid sequence selected from the group consisting of SEQ ID NO: 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 242, 244, 248, 250, 254, 256, 258, 262, and 264.

In some embodiments, the polypeptide is capable of forming compound (2b) in at least 99% enantiomeric excess and with at least 4-fold the enzymatic activity of the polypeptide of SEQ ID NO:10.

In some embodiments, the polypeptide capable of forming compound (2b) in at least 99% enantiomeric excess and with at least 4 fold or more the enzymatic activity of the polypeptide of SEQ ID NO:10 comprises an amino acid sequence selected from the group consisting of SEQ ID NO: 16, 18, 20, 22, 24, 26, 28, 30, 32, 42, 44, 86, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, and 158.

As provided herein, in some embodiments, the monooxygenase polypeptides are capable of forming decreased amount of sulfone-byproduct of compound (3) as compared to the polypeptide of SEQ ID NO: 52. Exemplary monooxygenase polypeptides capable of forming decreased amount of sulfone-byproduct as compared to the polypeptide of SEQ ID NO:52 can comprise an amino acid sequence selected from the group consisting of SEQ ID NO: 54, 58, 60, 62, 64, 70, 72, 76, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, and 158.

In some embodiments, the polypeptide is capable of forming sulfone-byproduct of compound (3) in an amount that is decreased by about 20% or higher as compared to the amount produced by the polypeptide of SEQ ID NO: 52 and comprises an amino acid sequence selected from the group consisting of SEQ ID NO: 54, 58, 60, 62, 64, 70, 72, 76, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, and 158.

In some embodiments, the polypeptide is capable of forming sulfone-byproduct of compound (3) in an amount that is decreased by about 40% or higher as compared to the amount produced by the polypeptide of SEQ ID NO: 52 and comprises an amino acid sequence selected from the group consisting of SEQ ID NO: 54, 72, 76, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, and 158.

In some embodiments, the polypeptide is capable of forming sulfone-byproduct of compound (3) in an amount that is decreased by about 90% or higher as compared to the amount produced by the polypeptide of SEQ ID NO:52 and comprises an amino acid sequence selected from the group consisting of SEQ ID NO: 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, and 158.

As noted above, in some embodiments, the polypeptide amino acid sequence can have residue differences as compared to SEQ ID NO: 2 at residue positions associated with increases in protein expression. Accordingly, in some embodiments, the polypeptide amino acid sequences described herein can further include at the residue position corresponding to X3a hydroxyl-containing residue. In some embodiments, the residue at position corresponding to X3 is T. This feature is particularly useful for enhanced expression in a bacterial host organism, particularly *E. coli*.

Table 2A below provides exemplary engineered polypeptides capable of converting compound (1) to compound (2b). Odd numbered SEQ ID NOs refer to the nucleotide sequence encoding the amino acid sequence provided by the even numbered SEQ ID NOs. The residue differences are based on comparison to reference sequence of SEQ ID NO:2, the naturally occurring cyclohexanone monooxygenase of *Acinetobacter* sp NCIMB9871. Activity improvements are presented as "fold improvement over parent" or "FIOP", where the parent polypeptide amino acid sequence used as reference is indicated by the SEQ ID NO in a separate column. The polypeptides of SEQ ID NO: 4 and 6 have the ability to convert compound (1) to compound (2) but the product has enantiomeric excess of the R-isomer. The monooxygenase of SEQ ID NO: 4 has about 1.7 fold the activity of SEQ ID NO:2.

The Activity FIOP and enantioselectivity (% ee) of the exemplary non-naturally occurring monooxygenase polypeptides ("engineered CHMO polypeptides") of Table 2A in carrying out the biocatalytic conversion of the substrate compound (1) to the product compound (2) were determined using the following general HTP assay conditions: 6 g/L substrate compound (1), 10 µL of lysate of the engineered CHMO polypeptide, 1 g/L KRED of SEQ ID NO: 268, 0.1 g/L NADP, in a solution of 50 mM potassium phosphate buffer, 8% (v/v) IPA, 2% acetone, 15% N-methyl-2-pyrrolidone (NMP), pH 9.0, 25° C. reaction temperature and 24 h reaction time. Further details of the HTP assay used are described in the Examples.

TABLE 2A

Engineered CHMO polypeptides having improved properties

| SEQ ID NO (nt/aa) | Residue Differences (relative to SEQ ID NO: 2) | Activity FIOP (relative to SEQ ID NO: 2) | % ee of S Isomer |
|---|---|---|---|
| 1/2 | NA (wild-type) | 1.0 | ND |
| 3/4 | F432A; T433A; L435S; W490R | + | −95.7 |
| 5/6 | K326T; L329N; V383I; F432S; T433G; L435A; Q451R; W490R | + | −98.9 |
| 7/8 | K326C; N386S; F432A; T433A; L435S; W490R | + | 6.7 |
| 9/10 | K326C; N386S; F432A; T433A; L435S; S438I; D448V; W490R | + | 90.9 |
| 11/12 | K326C; N386S; F432L; T433A; L435S; S438I; D448V; W490R | + | 99.1 |

TABLE 2A-continued

Engineered CHMO polypeptides having improved properties

| SEQ ID NO (nt/aa) | Residue Differences (relative to SEQ ID NO: 2) | Activity FIOP (relative to SEQ ID NO: 2) | % ee of S Isomer |
|---|---|---|---|
| 13/14 | K326C; N386S; F432A; T433A; L435S; S438I; D448W; W490R | + | 92.9 |
| 15/16 | Q3T; K326C; N386S; F432L; T433A; L435S; S438I; D448V; W490R | ++ | 99.9 |
| 17/18 | Q3T; Q34K; W240K; A288I; K326C; N386S; F432L; T433A; L435S; S438I; D448V; W490R; A516V | ++ | 100.0 |
| 19/20 | Q3T; Q34K; E161A; A288I; K326C; N386S; F432L; T433A; L435S; S438I; D448V; W490R; I537T | +++ | 100.0 |
| 21/22 | Q3T; K32N; E161A; F174L; A288I; K326C; N386S; F432L; T433A; L435S; S438I; D448V; W490R | +++ | 100.0 |
| 23/24 | Q3T; Q34K; V195G; W240K; A288I; K326C; N386S; T415A; F432L; T433A; L435S; S438I; D448V; W490R; A516V; I537T | +++ | 100.0 |
| 25/26 | Q3T; Q34K; E123D; W240K; L244V; A288I; K326C; N386S; M390R; T415A; F432L; T433A; L435S; S438I; D448V; W490R; A516V | +++ | 100.0 |
| 27/28 | Q3T; Q34K; W240K; A288I; K326C; N386S; T415A; F432L; T433A; L435S; S438I; D448V; W490R; A516V; I537T | +++ | 100.0 |
| 29/30 | Q3T; Q34K; W240K; K326C; N386S; P408A; P428L; F432L; T433V; L435S; S438I; D448V; W490R; A516V; L532P; P540A | +++ | 101.0 |
| 31/32 | Q3T; Q34K; A209P; W240K; A288I; K326C; N386S; T415A; F432L; T433A; L435S; S438I; D448V; W490R; A516V; I537T | +++ | 100.0 |
| 33/34 | Q3T; G15A; Q34K; L141I; A199P; H201N; W240K; A288I; K326C; D367E; F368N; N386S; T415A; F432L; T433A; L435S; S438I; D448V; W490R; I537T | +++ | |
| 35/36 | Q3T; Q34K; L141V; A209P; W240K; A288I; K326C; N386S; T415A; F432L; T433A; L435S; S438I; D448V; W490R; A516V; I537T | +++ | |
| 37/38 | Q3T; Q34K; L141V; A209P; W240K; A288I; K326C; N386S; T415A; F432L; T433A; L435S; S438I; D448V; W490R; A516V; I537T | +++ | |
| 39/40 | Q3T; Q34K; A146T; A209P; W240K; A288I; K326C; N386S; T415A; F432L; T433A; L435S; S438I; D448V; W490R; F505W; A516V; I537T | ++ | |
| 41/42 | Q3T; Q34K; N107K; L141V; A209P; W240K; A288I; K326C; N386S; T415A; F432L; T433A; L435S; S438I; D448V; W490R; A516V; I537T | +++ | |
| 43/44 | Q3T; V22A; Q34K; G44E; E161V; G176D; A194S; A209P; W240K; F277L; A288I; K326C; C330S; V354A; N386S; T415A; F432L; T433A; L435S; S438I; D448V; W490R; A516V; I537T | +++ | 100.0 |
| 45/46 | Q3T; Q34K; A146T; A209P; W240K; A288I; K326C; V354A; N386S; T415A; F432L; T433A; L435S; S438I; D448V; W490R; A516V; I537T | +++ | 97.8 |
| 47/48 | Q3T; Q34K; A209P; W240K; A288I; K326C; N386S; T415A; F432L; T433A; L435S; S438I; D448V; W490R; A516V; I537T | +++ | 97.7 |
| 49/50 | Q3T; Q34K; S74G; Q92N; A146V; L149V; E161D; F174L; A209P; W240K; A288I; K326C; N386S; T415A; F432L; T433A; L435S; S438I; D448V; W490R; A516V; L532P; I537T | +++ | 97.3 |
| 51/52 | Q3T; Q34K; L141V; A209P; W240K; A288I; K326C; N386S; T415A; F432L; T433A; L435S; S438I; D448V; S489C; W490R; A516V; I537T | ++++ | |
| 53/54 | Q3T; G14A; Q34K; L141V; A146V; F174L; A209P; W240K; A288I; K326C; N386S; T415A; F432L; T433A; L435S; S438I; D448V; S489C; W490R; A516V; I537T | ++++ | |
| 55/56 | Q3T; G14A; Q34K; L141V; A146V; F174L; A209P; W240K; A245G; F277L; A288I; K326C; C330G; N386S; T415A; F432L; T433A; L435S; S438I; D448V; W490R; A516V; I537T | ++++ | |
| 57/58 | Q3T; G14A; Q34K; L141V; A209P; W240K; A288I; K326C; N386S; T415A; L426F; F432L; T433A; L435S; S438I; D448V; S489C; W490R; A516V; I537T | ++++ | |
| 59/60 | Q3T; G14A; Q34K; L141V; A209P; W240K; A288I; K326C; N386S; T415A; L426F; F432L; T433A; L435S; S438I; D448V; S489C; W490R; A516V; I537T | ++++ | |
| 61/62 | Q3T; G14A; Q34K; L141V; A209P; W240K; A288I; K326C; N386S; T415A; L426F; F432L; T433A; L435S; S438I; D448V; S489C; W490R; A516V; I537T | ++++ | |
| 63/64 | Q3T; G14A; Q34K; L141V; A209P; W240K; A288I; K326C; N386S; T415A; L426F; F432L; T433A; L435S; S438I; D448V; S489C; W490R; A516V; I537T | ++++ | |
| 65/66 | Q3T; Q34K; L141V; F174L; A209P; W240K; A288I; E307R; K326C; N386S; T415A; F432L; T433A; L435S; S438I; D448V; M481K; S489C; W490R; F505L; A516V; I537T | ++++ | |
| 67/68 | Q3T; Q34K; Q83E; L141V; F174L; A209P; W240K; A288I; E307R; K326C; N386S; T415A; F432L; T433A; L435S; S438I; D448V; M481K; S489C; W490R; F505L; A516V; I537T | ++++ | |
| 69/70 | Q3T; G14A; Q34K; L141V; A209P; W240K; A288I; E307R; K326C; N386S; T415A; L426F; F432L; T433A; L435S; S438I; D448V; M481K; S489C; W490R; F505L; A516V; I537T | ++++ | |
| 71/72 | Q3T; G14A; Q34K; L141V; A209P; W240K; A288I; E307R; K326C; N386S; T415A; L426F; F432L; T433A; L435S; S438I; D448V; M481K; S489C; W490R; F505L; A516V; I537T | ++++ | |

TABLE 2A-continued

Engineered CHMO polypeptides having improved properties

| SEQ ID NO (nt/aa) | Residue Differences (relative to SEQ ID NO: 2) | Activity FIOP (relative to SEQ ID NO: 2) | % ee of S Isomer |
|---|---|---|---|
| 73/74 | Q3T; G14A; Q34K; L141V; A209P; W240K; A288I; K326C; N386S; T415A; L426F; F432L; T433A; L435S; S438I; D448V; C475A; S489C; W490R; A516V; I537T | ++++ | |
| 75/76 | Q3T; G14A; Q34K; Q111T; L141V; A209P; W240K; A288I; E307R; K326C; N386S; V388K; T415A; L426F; F432L; T433A; L435S; S438I; D448V; M481K; S489C; W490R; F505L; A516V; I537T | +++++ | |
| 77/78 | Q3T; G14A; Q34K; A43G; Q111T; L141V; A209P; W240K; A288I; E307R; K326C; N386S; V388K; T415A; L426F; F432L; T433A; L435S; S438I; D448V; M481K; S489C; W490R; F505L; A516V; I537T | +++++ | |
| 79/80 | Q3T; G14A; Q34K; A43G; H114R; L141V; I155M; A209P; W240K; A288I; E307R; K326C; N386S; T415A; L426F; F432L; T433A; L435S; S438I; D448V; T449M; M481K; S489C; W490R; F505L; A516V; I537T | +++++ | |
| 81/82 | Q3T; G14A; Q34K; A43G; H114R; L141V; I155M; A209P; W240K; A288I; E307R; K326C; N386S; T415A; L426F; F432L; T433A; L435S; S438I; D448V; T449M; E459K; M481K; S489C; W490R; F505L; A516V; I537T | +++++ | |
| 83/84 | Q3T; G14A; Q34K; A43G; Q111T; L141V; L149W; A209P; W240K; A288I; E307R; K326C; F368V; N386S; V388K; T415A; L426F; F432L; T433A; L435S; S438I; D448V; M481K; S489C; W490R; F505L; A516V; I537T | +++++ | |
| 85/86 | Q3T; G14A; Q34K; Q111T; L141V; A209P; W240K; F246Y; A288I; E307R; K326C; N386S; V388K; T415A; L426F; F432L; T433A; L435S; S438I; D448V; M481K; S489C; W490R; F505L; A516V; I537T | ++++ | 99.4 |
| 87/88 | Q3T; G14A; Q34K; Q111T; L141V; A209P; W240K; F246W; A288I; E307R; K326C; N386S; V388K; T415A; L426F; F432L; T433A; L435S; S438I; D448V; M481K; S489C; W490R; F505L; A516V; I537T | ++++ | 98.7 |
| 89/90 | Q3T; G14A; Q34K; Q111T; L141V; A209P; W240K; F277M; A288I; E307R; K326C; N386S; V388K; T415A; L426F; F432L; T433A; L435S; S438I; D448V; M481K; S489C; W490R; F505L; A516V; I537T | ++++ | 98.2 |
| 91/92 | Q3T; G14A; Q34K; Q111T; L141V; A209P; W240K; A288I; E307R; K326C; N386S; V388K; T415A; L426F; F432L; T433A; L435S; S438I; D448V; T449F; V454I; M481K; S489C; W490R; F505L; A516V; I537T | +++++ | |
| 93/94 | Q3T; G14A; Q34K; Q111T; L141V; A209P; W240K; F246Y; L248C; A288I; E307R; K326C; N386S; V388K; T415A; L426F; F432L; T433A; L435S; S438I; D448V; M481K; S489C; W490R; F505L; A516V; I537T | +++++ | 99.5 |
| 95/96 | Q3T; G14A; Q34K; Q111T; L141V; A209P; W240K; F246Y; L248N; A288I; E307R; K326C; N386S; V388K; T415A; L426F; F432L; T433A; L435S; S438I; D448V; M481K; S489C; W490R; F505L; A516V; I537T | +++++ | 99.5 |
| 97/98 | Q3T; G14A; Q34K; Q111T; L141V; A209P; W240K; F246Y; L248V; A288I; E307R; K326C; N386S; V388K; T415A; L426F; F432L; T433A; L435S; S438I; D448V; M481K; S489C; W490R; F505L; A516V; I537T | +++++ | 99.3 |
| 99/100 | Q3T; G14A; Q34K; Q111T; L141V; A209P; W240K; F246Y; L248S; A288I; E307R; K326C; N386S; V388K; T415A; L426F; F432L; T433A; L435S; S438I; D448V; M481K; S489C; W490R; F505L; A516V; I537T | ++++ | 99.4 |
| 101/102 | Q3T; G14A; Q34K; Q111T; L141V; A209P; W240K; F246Y; A288I; E307R; K326C; N386S; V388K; T415A; L426F; F432L; T433A; L435S; S438I; D448V; M481K; S489C; W490R; F505L; L507F; A516V; I537T | ++++ | |
| 103/104 | Q3T; G14A; Q34K; Q111T; L141V; A209P; W240K; F246Y; L248V; A288I; E307R; K326C; N386S; V388K; T415A; L426F; F432L; T433A; L435S; S438I; D448V; M481K; S489C; W490R; F505L; A516V; E526V; I537T; P540Q | +++++ | |
| 105/106 | Q3T; G14A; Q34K; E59P; Q111T; L141V; A209P; W240K; F246Y; L248V; A288I; E307R; K326C; N386S; V388K; T415A; L426F; F432L; T433A; L435S; S438I; D448V; M481K; S489C; W490R; K499L; F505L; A516V; I537T | ++++ | |
| 107/108 | Q3T; G14A; Q34K; Q111T; L141V; A209P; W240K; F246Y; L248V; F277M; A288I; E307R; K326C; N386S; V388K; T415A; L426F; F432L; T433A; L435S; S438I; D448V; M481K; S489C; W490R; K499L; F505L; A516V; E526V; I537T; P540Q | +++++ | |
| 109/110 | Q3T; G14A; Q34K; Q111T; L141V; A209P; W240K; F246Y; L248V; F277M; A288I; E307R; K326C; N386S; V388K; T415A; L426F; | +++++ | |

TABLE 2A-continued

Engineered CHMO polypeptides having improved properties

| SEQ ID NO (nt/aa) | Residue Differences (relative to SEQ ID NO: 2) | Activity FIOP (relative to SEQ ID NO: 2) | % ee of S Isomer |
|---|---|---|---|
| | F432L; T433A; L435S; S438I; D448V; M481K; S489C; W490R; F505L; A516V; I537T; P540Q | | |
| 111/112 | Q3T; G14A; Q34K; Q111T; L141V; A209P; W240K; F246Y; L248V; F277M; A288I; E307R; K326C; N386S; V388K; T415A; L426F; F432L; T433A; L435S; S438I; D448V; M481K; S489C; W490R; F505L; A516V; I537T; P540Q | +++++ | |
| 113/114 | Q3T; G14A; Q34K; A43G; Q111T; L141V; L149W; A209P; W240K; F246Y; L248S; A288I; E307R; K326C; D341E; N386S; V388K; T415A; L426F; F432L; T433A; L435S; S438I; D448V; T449L; M481K; S489C; W490R; F505L; A516V; I537T | +++++ | |
| 115/116 | Q3T; G14A; Q34K; A43G; L71M; Q111T; L141V; L149W; A209P; W240K; F246Y; L248V; F277M; A288I; E307R; K326C; N386S; V388K; M390I; T415A; L426F; F432L; T433A; L435S; S438I; D448V; M481K; S489C; W490R; K499L; F505L; A516V; E526V; I537T; P540Q | +++++ | |
| 117/118 | Q3T; G14A; Q34K; A43G; L71M; Q111T; L141V; L149W; F174L; A209P; W240K; F246Y; L248V; F277M; A288I; E307R; K326C; N386S; V388K; M400I; T415A; L426F; F432L; T433A; L435S; S438I; D448V; M481K; S489C; W490R; K499L; F505L; A516V; E526V; I537T; P540Q | +++++ | |
| 119/120 | Q3T; G14A; Q34K; L71M; Q111T; L141V; L149W; F174L; A209P; W240K; F246Y; L248V; F277M; A288I; E307R; K326C; N386S; V388K; M390I; T415A; L426F; F432L; T433A; L435S; S438I; D448V; M481K; S489C; W490R; K499L; F505L; A516V; E526V; I537T; P540Q | +++++ | |
| 121/122 | Q3T; G14A; Q34K; A43G; L71M; Q111T; L141V; L149W; F174L; A209P; W240K; F246Y; L248V; F277M; A288I; E307R; K326C; N386S; V388K; M390I; T415A; L426F; F432L; T433A; L435S; S438I; D448V; M481K; S489C; W490R; K499L; F505L; A516V; E526V; I537T; P540Q | +++++ | |
| 123/124 | Q3T; G14A; Q34K; A43G; L71M; Q111T; L141V; L149W; F174I; A209P; W240K; F246Y; L248V; F277M; A288I; E307R; K326C; D341E; V383G; N386S; V388K; M390I; M400I; T415A; L426F; F432L; T433A; L435S; S438I; D448V; T449F; M481K; Q488K; S489C; W490R; K499L; F505L; A516V; E526V; I537T; P540Q | +++++ | |
| 125/126 | Q3T; G14A; Q34K; A43G; L71M; Q111T; L141V; L149W; A209P; W240K; F246Y; L248V; F277M; A288I; E307R; K326C; V383G; N386S; V388K; M400I; T415A; L426F; F432L; T433A; L435S; S438I; D448V; T449F; M481K; Q488K; S489C; W490R; K499L; F505L; A516V; E526V; I537T; P540Q | +++++ | |
| 127/128 | Q3T; G14A; Q34K; A39G; A43G; L71M; Q111T; L141V; L149W; A209P; W240K; F246Y; L248V; F277M; A288I; E307R; K326C; V383G; N386S; V388K; M400I; T415A; L426F; F432L; T433A; L435S; S438I; D448V; T449F; M481K; Q488K; S489C; W490R; K499L; F505L; A516V; E526V; I537T; P540Q | +++++ | |
| 129/130 | Q3T; G14A; Q34K; A43G; L71M; Q111T; L141V; L149W; A209P; W240K; F246Y; L248V; F277M; A288I; E307R; K326C; V383G; N386S; V388K; M390I; M400I; T415A; L426F; F432L; T433A; L435S; S438I; D448V; T449L; M481K; Q488K; S489C; W490R; K499L; F505L; A516V; E526V; I537T; P540Q | +++++ | |
| 131/132 | Q3T; G14A; Q34K; A43G; L71M; Q111T; L141V; L149W; F174I; A209P; W240K; F246Y; L248V; F277M; A288I; E307R; K326C; D341E; V383G; N386S; V388K; M390I; M400I; T415A; L426F; F432L; T433A; L435S; S438I; D448V; T449F; M481K; Q488K; S489C; W490R; K499R; F505L; A516V; E526V; I537T; P540Q; | +++++ | |
| 133/134 | Q3T; G14A; Q34K; A43G; L71M; Q111T; L141V; L149W; F174I; A209P; W240K; A245G; F246Y; L248V; F277M; A288I; E307R; K326C; D341E; V383G; N386S; V388K; M390I; M400I; T415A; L426F; F432L; T433A; L435S; S438I; D448V; T449F; M481K; Q488K; S489C; W490R; K499L; F505L; A516V; E526V; I537T; P540Q; | +++++ | |
| 135/136 | Q3T; G14A; Q34K; K38E; A43G; C64R; L71M; Q83E; Q111T; L141V; L149W; F174I; A209P; W240K; A245G; F246Y; L248V; F277M; A288I; E307C; K326C; D341E; M373L; V383G; N386S; V388K; M390I; M400I; E406D; T415A; L426F; F432L; T433A; L435S; S438I; D448V; T449F; T464D; M481K; Q488K; S489C; W490R; F505L; A516V; E526V; I537T; P540Q; | +++++ | |
| 137/138 | Q3T; G14A; Q34K; A43G; L71M; Q83E; Q111T; L141V; L149W; F174I; A209P; W240K; A245G; F246Y; L248V; F277M; A288I; E307C; K326C; D341E; M373L; V383G; N386S; V388K; M390I; M400I; T415A; L426F; F432L; T433A; L435S; S438I; D448V; T449F; | +++++ | |

TABLE 2A-continued

Engineered CHMO polypeptides having improved properties

| SEQ ID NO (nt/aa) | Residue Differences (relative to SEQ ID NO: 2) | Activity FIOP (relative to SEQ ID NO: 2) | % ee of S Isomer |
|---|---|---|---|
| | T464D; M481K; Q488K; S489C; W490R; F505L; A516V; E526V; I537T; P540Q; | | |
| 139/140 | Q3T; G14A; Q34K; A43G; L71M; Q83E; Q111T; L141V; L149W; F174I; A209P; W240K; A245G; F246Y; L248V; F277M; A288I; E307C; K326C; D341E; M373L; V383G; N386S; V388K; M390I; M400I; T415A; L426F; F432L; T433A; L435S; S438I; D448V; T449F; T464D; M481K; Q488K; S489C; W490R; K499G; F505L; A516V; E526V; I537T; P540Q; | +++++ | |
| 141/142 | Q3T; G14A; Q34K; A43G; L71M; Q83E; Q111T; L141V; L149W; F174I; A209P; W240K; A245G; F246Y; L248V; F277M; A288I; E307C; K326C; D341E; M373L; V383G; N386S; V388K; M390I; M400I; T415A; L426F; F432L; T433A; L435S; S438I; D448V; T449F; T464D; M481K; Q488K; S489C; W490R; F505L; A516V; E526V; I537T; P540Q; | +++++ | |
| 143/144 | Q3T; G14A; Q34K; K38E; A43G; L71M; Q83E; Q111T; L141V; L149W; F174I; A209P; W240K; A245G; F246Y; L248I; Q272R; F277M; A288I; E307C; K326C; D341E; M373L; V383G; N386S; V388K; M390I; M400I; T415A; L426F; F432L; T433A; L435S; S438I; D448V; T449F; T464D; M481K; Q488K; S489C; W490R; F505L; E512N; A516V; E526V; I537T; P540Q; A541G; | +++++ | |
| 145/146 | Q3T; G14A; Q34K; A43G; L71M; Q83E; Q111T; L141V; L149W; F174I; A209P; W240F; A245G; F246Y; L248V; F277M; A288I; E307C; K326C; D341E; M373L; V383G; N386S; V388K; M390I; M400I; T415A; L426F; F432L; T433A; L435S; S438I; D448V; T449F; T464D; E480N; M481K; Q488K; S489C; W490R; F505L; A516V; E526V; I537T; P540Q; | +++++ | |
| 147/148 | Q3T; G14A; Q34K; A43G; L71M; Q83E; Q111T; L141V; L149W; F174I; A209P; W240K; A245G; F246Y; L248V; F277M; A288I; E307C; K326C; D341E; M373L; A377G; V383G; N386S; V388K; M390I; M400I; T415A; L426F; F432L; T433A; L435S; S438I; D448V; T449F; T464D; M481K; Q488K; S489C; W490R; F505L; A516V; E526V; I537T; P540Q; | +++++ | |
| 149/150 | Q3T; G14A; Q34K; A43G; L71M; Q83E; Q111T; L141V; A146T; L149W; F174I; A194E; A209P; W240K; A245G; F246Y; L248V; F277M; A288I; E307C; K326C; D341E; M373L; A377G; V383G; N386S; V388K; M390I; M400I; T415A; L426F; F432L; T433A; L435S; S438I; D448V; T449F; T464D; E480N; M481K; Q488K; S489C; W490R; F505L; E512N; A516V; E526V; I537T; P540Q; | +++++ | |
| 151/152 | Q3T; G14A; Q34K; A43G; L71M; Q83E; Q111T; L141V; A146T; L149W; F174I; A194E; A209P; W240K; A245G; F246Y; L248V; F277M; A288I; E307C; P312Q; K326C; D341E; M373L; A377G; V383G; N386S; V388K; M390I; M400I; T415A; L426F; F432L; T433A; L435S; S438I; D448V; T449F; T464D; M481K; Q488K; S489C; W490R; F505L; E512N; A516V; E526V; I537T; P540Q; | +++++ | |
| 153/154 | Q3T; G14A; Q34K; A43G; L71M; Q83E; Q111T; L141V; A146T; L149W; F174I; A194E; A209P; W240K; A245G; F246Y; L248V; F277M; A288I; E307C; P312Q; K326C; D341E; M373L; A377G; V383G; N386S; V388K; M390I; M400I; T415A; L426F; F432L; T433A; L435S; S438I; D448V; T449F; T464D; M481K; Q488K; S489C; W490R; F505L; A516V; E526V; I537T; P540Q; | +++++ | |
| 155/156 | Q3T; G14A; Q34K; A43G; L71M; Q111T; L141V; L149W; F174I; A209P; W240K; F246Y; L248V; F277M; A288I; E307R; K326C; D341E; V383G; N386S; V388K; M390I; M400I; T415A; L426F; F432L; T433A; L435S; S438I; D448V; T449F; M481K; Q488K; S489C; W490R; F505L; A516V; E526V; I537T; P540Q; | +++++ | |
| 157/158 | Q3T; G14A; Q34K; A43G; L71M; Q111T; L141V; L149W; F174I; A209P; W240K; F246Y; L248V; F277M; A288I; E307R; K326C; D341E; V383G; N386S; V388K; M390I; M400I; T415A; L426F; F432L; T433A; L435S; S438I; D448V; T449F; T464D; M481K; Q488K; S489C; W490R; F505L; A516V; E526V; I537T; P540Q; | +++++ | |

+ = >1.5 fold
++ = ≥10 fold
+++ = ≥100 fold
++++ = ≥1000 fold
+++++ = ≥10000 fold In some embodiments, the polypeptide capable of converting compound (1) to compound (2a) in enantiomeric excess at a rate that is greater than 1.5 fold the rate of SEQ ID NO:2 can comprise an amino acid sequence that is at least about 80%, 85%, 86%, 87%, 88%, 89%, 90%, 91%, 92%, 93%, 94%, 95%, 96%, 97%, 98%, or 99% identical to a reference sequence selected from the group consisting of SEQ ID NO: 4, 6, 160, 162, 164, 166, 168, 170, 172, 174, 176, 178, 180, 182, 184, 186, 188, 190, 192, 194, 196, 198, 200, 202, 204, 206, and 208 with the proviso that the polypeptide amino acid sequence comprises any one of the set of residue differences as compared to SEQ ID NO:2 present in the polypeptide sequences represented by SEQ ID NO: 4, 6, 160, 162, 164, 166, 168, 170, 172, 174, 176, 178, 180, 182, 184, 186, 188, 190, 192, 194, 196, 198, 200, 202, 204, 206, or 208 as provided in Table 2A or 2B. In some embodiments, the polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40 residue differences at other amino acid residue positions as compared to the reference sequence. In some embodiments, the number of differences can be 1, 2, 3, 4, 5, 6, 7, 8, 9, 10, 11, 12, 14, 15, 16, 18, 20, 22, 24, 26, 30, 35, and 40 residue differences at other residue positions. The residue difference at these other positions can include conservative changes or non-conservative changes. In some embodiments, the residue differences can comprise conservative substitutions and non-conservative substitutions as compared to the reference sequence. In some embodiments, the residue differences are conservative substitutions.

In some embodiments, the polypeptide capable of converting compound (1) to compound (2b) in enantiomeric excess can comprise an amino acid sequence that is at least about 80%, 85%, 86%, 87%, 88%, 89%, 90%, 91%, 92%, 93%, 94%, 95%, 96%, 97%, 98%, 99% or more identical to a reference sequence of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266.

In some embodiments, the polypeptide capable of converting compound (1) to compound (2b) in enantiomeric excess can comprise an amino acid sequence that is at least about 80%, 85%, 86%, 87%, 88%, 89%, 90%, 91%, 92%, 93%, 94%, 95%, 96%, 97%, 98%, or 99% identical to a reference sequence selected from the group consisting of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266, with the proviso that the polypeptide amino acid sequence comprises any one of the set of residue differences, as compared to SEQ ID NO:2, present in any one of the polypeptide sequences represented by SEQ ID NO:8 to SEQ ID NO:158 in Table 2A or SEQ ID NO: 210 to SEQ ID NO: 266 in Table 2B. In some embodiments, the polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40 residue differences at other amino acid residue positions as compared to the reference sequence. In some embodiments, the number of differences can be 1, 2, 3, 4, 5, 6, 7, 8, 9, 10, 11, 12, 14, 15, 16, 18, 20, 22, 24, 26, 30, 35, and 40 residue differences at other residue positions. The residue difference at these other positions can include conservative changes or non-conservative changes. In some embodiments, the residue differences can comprise conservative substitutions and non-conservative substitutions as compared to the reference sequence. In some embodiments, the residue differences are conservative substitutions.

Table 2B below provides 53 exemplary non-naturally occurring monooxygenase polypeptides capable of converting compound (1) to compound (2) that differ by one amino acid residue difference from reference polypeptides of SEQ ID NO: 4, 16, 32, 52, 56, 58, and 76. Odd numbered SEQ ID NOs refer to the nucleotide sequence encoding the amino acid sequence provided by the even numbered SEQ ID NOs. The residue differences in Table 2B are provided based on comparison to the wild-type reference sequence of SEQ ID NO:2, as well as the reference polypeptides of SEQ ID NO: 4, 16, 32, 52, 56, 58, and 76.

The Activity FIOP and enantioselectivity (% ee) of the 53 exemplary non-naturally occurring monooxygenase polypeptides of Table 2B in carrying out the biocatalytic conversion of the substrate compound (1) (pyrmetazole) to the product compound (2) ((R)- or (S)-omeprazole) were determined that following general HTP assay conditions: 5 g/L pyrmetazole substrate, 10 µL of lysate of the engineered CHMO polypeptide, 1 g/L KRED of SEQ ID NO: 268, 0.5 g/L NADP, in a solution of 50 mM potassium phosphate buffer, 10% (v/v) IPA, pH 9.0, 25° C. reaction temperature and 24 h reaction time (with 400 rpm stirring). Further details of the HTP assay methods are described in the Examples.

TABLE 2B

| SEQ ID NO: (nt/aa) | Residue Difference (relative to parent reference sequence) | Residue Differences (relative to SEQ ID NO: 2) | Activity FLOP (relative to SEQ ID NO: 2) | % ee of S-isomer |
|---|---|---|---|---|
| 159/160 | L426H + SEQ ID NO: 4 | L426H; F432A; T433A; L435S; W490R; | + | −82.4 |
| 161/162 | L426Q + SEQ ID NO: 4 | L426Q; F432A; T433A; L435S; W490R; | + | −96.1 |
| 163/164 | A432H + SEQ ID NO: 4 | F432H; T433A; L435S; W490R; | + | −69.1 |
| 165/166 | A432K + SEQ ID NO: 4 | F432K; T433A; L435S; W490R; | + | −98.7 |
| 167/168 | A432T + SEQ ID NO: 4 | F432T; T433A; L435S; W490R; | + | −95.9 |

TABLE 2B-continued

| SEQ ID NO: (nt/aa) | Residue Difference (relative to parent reference sequence) | Residue Differences (relative to SEQ ID NO: 2) | Activity FLOP (relative to SEQ ID NO: 2) | % ee of S-isomer |
|---|---|---|---|---|
| 169/170 | A432D + SEQ ID NO: 4 | F432D; T433A; L435S; W490R; | + | −100.0 |
| 171/172 | A432C + SEQ ID NO: 4 | F432C; T433A; L435S; W490R; | + | −69.4 |
| 173/174 | A432I + SEQ ID NO: 4 | F432I; T433A; L435S; W490R; | + | −98.8 |
| 175/176 | A432L + SEQ ID NO: 4 | F432L; T433A; L435S; W490R; | ++ | −94.1 |
| 177/178 | A432Y + SEQ ID NO: 4 | F432Y; T433A; L435S; W490R; | + | −90.8 |
| 179/180 | A433F + SEQ ID NO: 4 | F432A; T433F; L435S; W490R; | + | −69.1 |
| 181/182 | A433K + SEQ ID NO: 4 | F432A; T433K; L435S; W490R; | + | −68.8 |
| 183/184 | A433W + SEQ ID NO: 4 | F432A; T433W; L435S; W490R; | + | −90.1 |
| 185/186 | R490E + SEQ ID NO: 4 | F432A; T433A; L435S; W490E; | ++ | −83.7 |
| 187/188 | R490P + SEQ ID NO: 4 | F432A; T433A; L435S; W490P; | ++ | −96.4 |
| 189/190 | F277V + SEQ ID NO: 4 | F277V; F432A; T433A; L435S; W490R; | + | −100.0 |
| 191/192 | R278H + SEQ ID NO: 4 | R278H; F432A; T433A; L435S; W490R; | + | −100.0 |
| 193/194 | F279Y + SEQ ID NO: 4 | F279Y; F432A; T433A; L435S; W490R; | + | −88.7 |
| 195/196 | M280W + SEQ ID NO: 4 | M280W; F432A; T433A; L435S; W490R; | ++ | −99.9 |
| 197/198 | F281H + SEQ ID NO: 4 | F281H; F432A; T433A; L435S; W490R; | ++ | −88.1 |
| 199/200 | K326A + SEQ ID NO: 4 | K326A; F432A; T433A; L435S; W490R; | ++ | −100.0 |
| 201/202 | K326S + SEQ ID NO: 4 | K326S; F432A; T433A; L435S; W490R; | ++ | −92.9 |
| 203/204 | K326L + SEQ ID NO: 4 | K326L; F432A; T433A; L435S; W490R; | ++ | −99.5 |
| 205/206 | K326D + SEQ ID NO: 4 | K326D; F432A; T433A; L435S; W490R; | + | −100.0 |
| 207/208 | S489P + SEQ ID NO: 4 | F432A; T433A; L435S; S489P; W490R; | ++ | −95.3 |
| 209/210 | L149M + SEQ ID NO: 16 | Q3T; L149M; K326C; N386S; F432L; T433A; L435S; S438I; D448V; W490R; | ++ | |
| 211/212 | F277L + SEQ ID NO: 16 | Q3T; F277L; K326C; N386S; F432L; T433A; L435S; S438I; D448V; W490R; | ++ | |
| 213/214 | L144A + SEQ ID NO: 16 | Q3T; L144A; K326C; N386S; F432L; T433A; L435S; S438I; D448V; W490R; | ++ | |
| 215/216 | R278N + SEQ ID NO: 16 | Q3T; R278N; K326C; N386S; F432L; T433A; L435S; S438I; D448V; W490R; | ++ | |

TABLE 2B-continued

| SEQ ID NO: (nt/aa) | Residue Difference (relative to parent reference sequence) | Residue Differences (relative to SEQ ID NO: 2) | Activity FLOP (relative to SEQ ID NO: 2) | % ee of S-isomer |
|---|---|---|---|---|
| 217/218 | L143V + SEQ ID NO: 16 | Q3T; L143V; K326C; N386S; F432L; T433A; L435S; S438I; D448V; W490R; | ++ | |
| 219/220 | L143N + SEQ ID NO: 16 | Q3T; L143N; K326C; N386S; F432L; T433A; L435S; S438I; D448V; W490R; | ++ | |
| 221/222 | A433L + SEQ ID NO: 16 | Q3T; K326C; N386S; F432L; T433L; L435S; S438I; D448V; W490R; | ++ | |
| 223/224 | L149F + SEQ ID NO: 32 | Q3T; Q34K; L149F; A209P; W240K; A288I; K326C; N386S; T415A; F432L; T433A; L435S; S438I; D448V; W490R; A516V; I537T; | +++ | |
| 225/226 | C330G + SEQ ID NO: 32 | Q3T; Q34K; A209P; W240K; A288I; K326C; C330G; N386S; T415A; F432L; T433A; L435S; S438I; D448V; W490R; A516V; I537T; | +++ | |
| 227/228 | L426F + SEQ ID NO: 56 | Q3T; G14A; Q34K; L141V; A146V; F174L; A209P; W240K; A245G; F277L; A288I; K326C; C330G; N386S; T415A; L426F; F432L; T433A; L435S; S438I; D448V; W490R; A516V; I537T; | +++ | |
| 229/230 | E282S + SEQ ID NO: 52 | Q3T; Q34K; L141V; A209P; W240K; E282S; A288I; K326C; N386S; T415A; F432L; T433A; L435S; S438I; D448V; S489C; W490R; A516V; I537T; | ++++ | |
| 231/232 | F505L + SEQ ID NO: 58 | Q3T; G14A; Q34K; L141V; A209P; W240K; A288I; K326C; N386S; T415A; L426F; F432L; T433A; L435S; S438I; D448V; S489C; W490R; F505L; A516V; I537T; | +++++ | |
| 233/234 | L149W + SEQ ID NO: 58 | Q3T; G14A; Q34K; L141V; L149W; A209P; W240K; A288I; K326C; N386S; T415A; L426F; F432L; T433A; L435S; S438I; D448V; S489C; W490R; A516V; I537T; | +++++ | |
| 235/236 | F246E + SEQ ID NO: 76 | Q3T; G14A; Q34K; Q111T; L141V; A209P; W240K; F246E; A288I; E307R; K326C; N386S; V388K; T415A; L426F; F432L; T433A; L435S; S438I; D448V; M481K; S489C; W490R; F505L; A516V; I537T; | ++++ | |
| 237/238 | F246H + SEQ ID NO: 76 | Q3T; G14A; Q34K; Q111T; L141V; A209P; W240K; F246H; A288I; E307R; K326C; N386S; V388K; T415A; L426F; F432L; T433A; L435S; S438I; D448V; M481K; S489C; W490R; F505L; A516V; I537T; | ++++ | 14.7 |
| 239/240 | F246Q + SEQ ID NO: 76 | Q3T; G14A; Q34K; Q111T; L141V; A209P; W240K; F246Q; A288I; E307R; K326C; N386S; V388K; T415A; L426F; F432L; T433A; L435S; S438I; D448V; M481K; S489C; W490R; F505L; A516V; I537T; | ++++ | 45.9 |
| 241/242 | F246S + SEQ ID NO: 76 | Q3T; G14A; Q34K; Q111T; L141V; A209P; W240K; F246S; A288I; E307R; K326C; N386S; V388K; T415A; L426F; F432L; T433A; L435S; S438I; D448V; M481K; S489C; W490R; F505L; A516V; I537T; | +++++ | 98.4 |
| 243/244 | F277Q + SEQ ID NO: 76 | Q3T; G14A; Q34K; Q111T; L141V; A209P; W240K; F277Q; A288I; E307R; K326C; N386S; V388K; T415A; L426F; F432L; T433A; L435S; S438I; D448V; M481K; S489C; W490R; F505L; A516V; I537T; | +++++ | 97.7 |
| 245/246 | F246W + SEQ ID NO: 76 | Q3T; G14A; Q34K; Q111T; L141V; A209P; W240K; F246W; A288I; E307R; K326C; N386S; V388K; T415A; L426F; F432L; T433A; L435S; S438I; D448V; M481K; S489C; W490R; F505L; A516V; I537T; | +++ | 80.8 |
| 247/248 | M280G + SEQ ID NO: 76 | Q3T; G14A; Q34K; Q111T; L141V; A209P; W240K; M280G; A288I; E307R; K326C; N386S; V388K; T415A; L426F; F432L; T433A; L435S; S438I; D448V; M481K; S489C; W490R; F505L; A516V; I537T; | +++++ | 97.9 |
| 249/250 | R278G + SEQ ID NO: 76 | Q3T; G14A; Q34K; Q111T; L141V; A209P; W240K; R278G; A288I; E307R; K326C; N386S; V388K; T415A; L426F; F432L; T433A; L435S; S438I; D448V; M481K; S489C; W490R; F505L; A516V; I537T; | +++++ | 98.4 |
| 251/252 | M280R + SEQ ID NO: 76 | Q3T; G14A; Q34K; Q111T; L141V; A209P; W240K; M280R; A288I; E307R; K326C; N386S; V388K; T415A; L426F; F432L; T433A; L435S; S438I; D448V; M481K; S489C; W490R; F505L; A516V; I537T; | ++ | |
| 253/254 | R278S + SEQ ID NO: 76 | Q3T; G14A; Q34K; Q111T; L141V; A209P; W240K; R278S; A288I; E307R; K326C; N386S; V388K; T415A; L426F; F432L; T433A; L435S; S438I; D448V; M481K; S489C; W490R; F505L; A516V; I537T; | +++++ | 98.5 |
| 255/256 | F281A + SEQ ID NO: 76 | Q3T; G14A; Q34K; Q111T; L141V; A209P; W240K; F281A; A288I; E307R; K326C; N386S; V388K; T415A; L426F; F432L; T433A; L435S; S438I; D448V; M481K; S489C; W490R; F505L; A516V; I537T; | +++++ | 98.2 |

TABLE 2B-continued

| SEQ ID NO: (nt/aa) | Residue Difference (relative to parent reference sequence) | Residue Differences (relative to SEQ ID NO: 2) | Activity FLOP (relative to SEQ ID NO: 2) | % ee of S-isomer |
|---|---|---|---|---|
| 257/258 | F281S + SEQ ID NO: 76 | Q3T; G14A; Q34K; Q111T; L141V; A209P; W240K; F281S; A288I; E307R; K326C; N386S; V388K; T415A; L426F; F432L; T433A; L435S; S438I; D448V; M481K; S489C; W490R; F505L; A516V; I537T; | +++++ | 94.0 |
| 259/260 | Q488K + SEQ ID NO: 76 | Q3T; G14A; Q34K; Q111T; L141V; A209P; W240K; A288I; E307R; K326C; N386S; V388K; T415A; L426F; F432L; T433A; L435S; S438I; D448V; M481K; Q488K; S489C; W490R; F505L; A516V; I537T; | +++++ | |
| 261/262 | Q488F + SEQ ID NO: 76 | Q3T; G14A; Q34K; Q111T; L141V; A209P; W240K; A288I; E307R; K326C; N386S; V388K; T415A; L426F; F432L; T433A; L435S; S438I; D448V; M481K; Q488F; S489C; W490R; F505L; A516V; I537T; | +++++ | 97.1 |
| 263/264 | Q488L + SEQ ID NO: 76 | Q3T; G14A; Q34K; Q111T; L141V; A209P; W240K; A288I; E307R; K326C; N386S; V388K; T415A; L426F; F432L; T433A; L435S; S438I; D448V; M481K; Q488L; S489C; W490R; F505L; A516V; I537T; | +++++ | 97.5 |
| 265/266 | F246R + SEQ ID NO: 76 | Q3T; G14A; Q34K; Q111T; L141V; A209P; W240K; F246R; A288I; E307R; K326C; N386S; V388K; T415A; L426F; F432L; T433A; L435S; S438I; D448V; M481K; S489C; W490R; F505L; A516V; I537T; | +++ | |

+ = >1.5 fold
++ = ≥10 fold
+++ = ≥100 fold
++++ = ≥500 fold
+++++ = ≥1000 fold

Accordingly, in some embodiments, the present disclosure provides and engineered polypeptide capable of converting compound (1) to compound (2) can comprise an amino acid sequence that is at least about 80%, 85%, 86%, 87%, 88%, 89%, 90%, 91%, 92%, 93%, 94%, 95%, 96%, 97%, 98%, 99% or more identical to a reference sequence of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, or 158, and comprises one or more amino acid differences relative to the reference sequence selected from: X143N; X143V; X144A; X149F; X149M; X149W; X246E; X246H; X246Q; X246R; X246S; X246W; X277L; X277Q; X277V; X278G; X278H; X278N; X278S; X279Y; X280G; X280R; X280W; X281A; X281H; X281S; X282S; X326A; X326S; X326L; X326D; X330G; X426F; X426H; X426Q; X432C; X432D; X432H; X432I; X432K; X432L; X432T; X432Y; X433F; X433K; X433L; X433W; X488K; X488F; X488L; X489P; X490E; X490P; and X505L (i.e., the amino acid differences of Table 2B). In some embodiments, the engineered polypeptide comprises a sequence at least about 80%, 85%, 86%, 87%, 88%, 89%, 90%, 91%, 92%, 93%, 94%, 95%, 96%, 97%, 98%, 99% or more identical to a sequence of any one of SEQ ID NO: 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, or 266. In some embodiments, the engineered polypeptide is capable of converting compound (1) to either the (R)- or the (S)-enantiomer of compound (2) in enantiomeric excess.

In some embodiments, the present disclosure provides an engineered polypeptide is capable of converting a structurally similar analog of the substrate pyrmetazole (e.g., a compound of structural formula (I)) to either the (R)- or the (S)-enantiomer of the corresponding analog prazole compound (e.g., compound of structural formula (II)) in enantiomeric excess, which comprises an amino acid sequence that is at least about 80%, 85%, 86%, 87%, 88%, 89%, 90%, 91%, 92%, 93%, 94%, 95%, 96%, 97%, 98%, 99% or more identical to a reference sequence of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, or 266. In some embodiments, the engineered polypeptide is capable of converting an pyrmetazole analog substrate to an omeprazole analog compound selected from: (R) or (S)-lansoprazole, (R) or (S)-tenatoprazole, (R) or (S)-rabeprazole, (R) or (S)-pantoprazole, (R) or (S)-ilaprazole, (R) or (S)-leminoprazole, (R) or (S)-saviprazole, and (R) or (S)-TY-11345.

In some embodiments, the present disclosure provides an engineered polypeptide capable of converting the pyrmetazole analog substrate 5-(difluoromethoxy)-2-((3,4-dimethoxypyridin-2-yl)methylthio)-1H-benzo[d]imidazole to the omeprazole analog compound, (S)-pantoprazole in enantiomeric excess. In some embodiments, the polypeptide capable of producing (S)-pantoprazole in enantiomeric excess comprises an amino acid sequence selected from the group consisting of SEQ ID NO: 70, 72, 76, 78, 80, 82, 84, 86, 90, 92, 94, 96, 98, 100, 102, 104, 106, 108, 110, 112, 114, 116, 118, 120, 122, 126, 128, 130, 228, 232, 244, 248, 256, 258, 260, 262, and 264.

In some embodiments, the present disclosure provides an engineered polypeptide capable of converting the pyrmetazole analog substrate 5-methoxy-2-((4-methoxy-3,5-dimethylpyridin-2-yl)methylthio)-1H-imidazo[4,5-b]pyridine to the omeprazole analog compound, (S)-tenatoprazole, in enantiomeric excess. In some embodiments, the polypeptide capable of producing (S)-tenatoprazole comprises an amino acid sequence selected from the group consisting of SEQ ID NO: 66, 102, 104, 114, 122, 124, 128, 232, 238, 244, 260, 262, and 264.

In some embodiments, the present disclosure provides an engineered polypeptide capable of converting the pyrmetazole analog substrate 2-((4-(3-methoxypropoxy)-3-methylpyridin-2-yl)methylthio)-1H-benzo[d]imidazole to the omeprazole analog compound, (S)-rabeprazole, in enantiomeric excess. in some embodiments, the polypeptide capable of producing (S)-rabeprazole comprises an amino acid sequence selected from the group consisting of SEQ ID NO: 62, 76, 84, 86, 124, 238, 240, 250, 258, 262, and 264.

The present disclosure also contemplates engineered CHMO polypeptides capable of converting compound (1) to compound (2), where the polypeptides comprise an amino acid sequence comprising mutations based on locations or regions in the structure of the parent polypeptide. Accordingly, referring to Table 3, a variant of a parent polypeptide (e.g., SEQ ID NO: 2) can include an amino acid substitution at a particular residue at a location in the structure of the parent polypeptide as identified in Table 3. Exemplary substitutions at each of the relevant locations are also identified in Table 3.

TABLE 3

Structural Locations Useful for Engineered CHMO Polypeptides

| Corresponding Position in SEQ ID NO: 2 | Structural Location |
|---|---|
| X3 | Surface |
| X14 | Buried - close to FAD |
| X15 | Buried - FAD-binding |
| X22 | Buried (non active site) |
| X32 | Surface |
| X34 | Surface |
| X39 | Partially Buried (FAD-Binding site) |
| X43 | Partially Buried - Near FAD |
| X44 | Buried - FAD-Binding |
| X59 | Surface (near active site) |
| X71 | Partially Buried (non-active site) |
| X74 | Surface |
| X83 | Surface |
| X92 | Surface |
| X107 | Surface |
| X111 | Surface |
| X113 | Buried (non active site) |
| X114 | Surface |
| X123 | Surface |
| X141 | Buried - FAD-Binding |
| X146 | Partially Buried |
| X149 | Surface |
| X154 | Surface |
| X155 | Surface |
| X161 | Surface |
| X174 | Buried (non active site) |
| X176 | Surface |
| X194 | Surface |
| X195 | Buried (non active site) |
| X199 | Buried (non active site) |
| X201 | Surface |
| X209 | Surface - close to NADP |
| X240 | Surface |
| X244 | Active Site |
| X245 | Active Site |
| X246 | Active Site |
| X248 | Surface |
| X277 | Active Site |
| X288 | Surface |

TABLE 3-continued

Structural Locations Useful for Engineered CHMO Polypeptides

| Corresponding Position in SEQ ID NO: 2 | Structural Location |
|---|---|
| X307 | Surface |
| X326 | Partially Buried (Active Site) |
| X329 | Buried (active site main chain) |
| X330 | Buried (active site main chain) |
| X341 | Surface |
| X354 | Surface |
| X367 | Surface |
| X368 | Surface |
| X383 | Active Site |
| X386 | Surface (FAD-Binding site) |
| X388 | Surface |
| X390 | Buried - FAD-Binding |
| X400 | Buried (non-active site) |
| X408 | Partially Buried (non active site) |
| X415 | Buried (non active site) |
| X426 | Active Site |
| X428 | Buried (active site main chain) |
| X432 | Active Site |
| X433 | Active Site |
| X435 | Active Site |
| X438 | Active Site |
| X448 | Surface |
| X449 | Surface |
| X451 | Buried (non active site) |
| X454 | Surface |
| X459 | Surface |
| X475 | Buried (non active site) |
| X481 | Surface |
| X488 | Surface |
| X489 | Partially Buried - Active Site |
| X490 | Active Site |
| X499 | Surface |
| X505 | Active Site |
| X507 | Partially Buried (near active site) |
| X516 | Surface |
| X526 | Surface |
| X532 | Surface |
| X537 | Surface |
| X540 | Surface |

In some embodiments, the polypeptides can comprise deletions of the engineered monooxygenase polypeptides described herein. Thus, for each and every embodiment of the polypeptides of the disclosure, the deletions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids of the polypeptides, as long as the functional activity of the monooxygenase polypeptide as described herein is maintained. In some embodiments, the functional activity is with respect to the conversion of compound (1) to compound (2) at a rate greater than 1.5 fold the rate of the monooxygenase of SEQ ID NO:2. In some embodiments, the functional activity of the polypeptide is with respect to the conversion of compound (1) to compound (2b) in enantiomeric excess. In some embodiments, the deletions can comprise, 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, or 1-40 amino acid residues. In some embodiments, the number of deletions can be 1, 2, 3, 4, 5, 6, 7, 8, 9, 10, 11, 12, 14, 15, 16, 18, 20, 22, 24, 26, 30, 35, or 40 amino acids. In some embodiments, the deletions can comprise deletions of 1, 2, 3, 4, 5, 6, 7, 8, 9, 10, 11, 12, 13, 14, 15, 16, 18, or 20 amino acid residues.

In some embodiments, the polypeptides can comprise fragments of the engineered polypeptides described herein. In some embodiments, the fragments can have about 80%, 90%, 95%, 98%, and 99% of the full-length polypeptide, e.g., the polypeptide of SEQ ID NO:8, as long as the functional activity of the polypeptide is maintained. In some embodiments, the functional activity is with respect to the conversion of compound (1) to compound (2) at a rate greater than 1.5 fold the rate of the monooxygenase of SEQ ID NO: 2. In some embodiments, the functional activity of the polypeptide with respect to the conversion of compound (1) to compound (2b) in enantiomeric excess.

In some embodiments, the polypeptides of the disclosure can be in the form of fusion polypeptides in which the engineered polypeptides are fused to other polypeptides, such as, by way of example and not limitation, antibody tags (e.g., myc epitope), purifications sequences (e.g., His tags for binding to metals), and cell localization signals (e.g., secretion signals). Thus, the engineered polypeptides described herein can be used with or without fusions to other polypeptides.

As will be understood by the skilled artisan, the polypeptides described herein are not restricted to the genetically encoded amino acids. In addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-enantiomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (MW); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opfl); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisolencine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (see, e.g., the various amino acids provided in Fasman, 1989, CRC Practical Handbook of Biochemistry and Molecular Biology, CRC Press, Boca Raton, Fla., at pp. 3-70 and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys (methylbenzyl), Cys (nitropyridinesulfenyl), Glu(δ-benzylester), Gln(xanthyl), Asn(N-δ-xanthyl), His(bom), His(benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the polypeptides can be present in whole cells transformed with gene(s) encoding the engineered monooxygenase enzyme, or as cell extracts, lysates, isolated polypeptide, or substantially purified, in a variety of different forms, including solid (e.g., lyophilized, spray-dried, and the like) or semisolid (e.g., a crude paste).

In some embodiments, the polypeptide described herein can be provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the polypeptides can be provided on a physical substrate. In some embodiments, the polypeptides can be provided in the form of an array in which the polypeptides are arranged in positionally distinct locations. The array can be used to test a variety of aryl alkyl sulfides for conversion by the polypeptides. "Substrate," "support," "solid support," "solid carrier," or "resin" in the context of arrays refer to any solid phase material. Substrate also encompasses terms such as "solid phase," "surface," and/or "membrane." A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

In certain embodiments, the kits of the present disclosure include arrays comprising a plurality of different engineered monooxygenase polypeptides at different addressable position, wherein the different polypeptides are different variants of a reference sequence each having at least one different improved enzyme property. Such arrays comprising a plurality of engineered polypeptides and methods of their use are described in, e.g., WO2009/008908A2.

5.3 POLYNUCLEOTIDES, EXPRESSION VECTORS, AND HOST CELLS

In another aspect, the present disclosure provides polynucleotides encoding the polypeptides described herein. The polynucleotides may be operatively linked to one or more heterologous regulatory sequences that control gene expression to create a recombinant polynucleotide capable of expressing the monooxygenase polypeptide. Expression constructs containing a heterologous polynucleotide encoding the engineered monooxygenase can be introduced into appropriate host cells to express the corresponding polypeptide.

It is to be understood that the availability of a polypeptide amino acid sequence provides a description of all the polynucleotides capable of encoding the subject polypeptide because of the knowledge of the codons corresponding to the various amino acids. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences presented in Tables 2A and 2B.

In some embodiments, the polynucleotides can be selected and/or engineered to comprise codons that are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. Since not all codons need to be replaced to optimize the codon usage of the monooxygenases (e.g., because the natural sequence can have preferred codons and because use of preferred codons may not be required for all amino acid residues), codon optimized polynucleotides encoding the monooxygenase polypeptides may contain preferred codons at about 40%, 50%, 60%, 70%, 80%, or greater than 90% of codon positions of the full length coding region.

In some embodiments, the polynucleotide encodes a polypeptide comprising an amino acid sequence that has at least about 80%, 85%, 86%, 87%, 88%, 89%, 90%, 91%, 92%, 93%, 94%, 95%, 96%, 97%, 98%, or 99% or more sequence identity to an amino acid sequence selected from the group consisting of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, and 266, wherein the polypeptide is capable of converting compound (1) to compound (2) at a rate that is greater than 1.5 fold the rate of the monooxygenase of SEQ ID NO:2.

In some embodiments, the polynucleotide encodes a polypeptide comprising an amino acid sequence that has at least about 80%, 85%, 86%, 87%, 88%, 89%, 90%, 91%, 92%, 93%, 94%, 95%, 96%, 97%, 98%, or 99% or more sequence identity to an amino acid sequence selected from the group consisting of SEQ ID NO: 4 and 6, wherein the polypeptide is capable of converting compound (1) to compound (2a) in enantiomeric excess and at a rate that is greater than 1.5 fold the rate of the monooxygenase of SEQ ID NO:2. In some embodiments, the polynucleotide encodes a polypeptide capable of converting compound (1) to compound (2a) in enantiomeric excess and comprises an amino acid sequence that is at least about 80%, 85%, 86%, 87%, 88%, 89%, 90%, 91%, 92%, 93%, 94%, 95%, 96%, 97%, 98%, or 99% identical to a reference sequence based on SEQ ID NO: 4, 6, 160, 162, 164, 166, 168, 170, 172, 174, 176, 178, 180, 182, 184, 186, 188, 190, 192, 194, 196, 198, 200, 202, 204, 206, or 208, with the proviso that the amino acid sequence comprises any one of the set of residue differences as compared to SEQ ID NO:2 as present in the polypeptide sequences of SEQ ID NO: 4, 6, 160, 162, 164, 166, 168, 170, 172, 174, 176, 178, 180, 182, 184, 186, 188, 190, 192, 194, 196, 198, 200, 202, 204, 206, or 208, as provided in Tables 2A or 2B.

In some embodiments, the polynucleotide encodes a polypeptide comprising an amino acid sequence that has at least about 80%, 85%, 86%, 87%, 88%, 89%, 90%, 91%, 92%, 93%, 94%, 95%, 96%, 97%, 98%, or 99% or more sequence identity to an amino acid sequence selected from the group consisting of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266, wherein the polypeptide is capable of converting compound (1) to compound (2b) in enantiomeric excess.

In some embodiments, the polynucleotide encodes a polypeptide capable of converting compound (1) to compound (2b) in enantiomeric excess and comprises an amino acid sequence that is at least about 80%, 85%, 86%, 87%, 88%, 89%, 90%, 91%, 92%, 93%, 94%, 95%, 96%, 97%, 98%, or 99% identical to a reference sequence selected from the group consisting of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122; 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266, with the proviso that the amino acid sequence comprises any one of the set of residue differences as compared to SEQ ID NO:2 as present in any one of the polypeptide sequences of SEQ ID NO:8 to SEQ ID NO:158 as provided in Table 2A or SEQ ID NO: 210 to SEQ ID NO: 266 as provided in Table 2B.

In some embodiments, the polynucleotides encoding the polypeptides are selected from the group consisting of SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 126, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, and 265.

In some embodiments, the polynucleotides are capable of hybridizing under highly stringent conditions to a polynucleotide comprising SEQ ID NO: 3, 5, 159, 161, 163, 165, 167, 169, 171, 173, 175, 177, 179, 181, 183, 185, 187, 189, 191, 193, 195, 197, 199, 201, 203, 205, or 207, or a complement thereof, where the highly stringently hybridizing polynucleotides encode a monooxygenase polypeptide capable of converting compound (1) to compound (2a) in enantiomeric excess at a rate greater than 1.5 fold the rate of the monooxygenase of SEQ ID NO:2.

In some embodiments, the polynucleotides are capable of hybridizing under highly stringent conditions to a polynucleotide selected from the group consisting of SEQ ID NO: 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 209, 211, 213, 215, 217, 219, 221, 223, 225, 227, 229, 231, 233, 235, 237, 239, 241, 243, 245, 247, 249, 251, 253, 255, 257, 259, 261, 263, and 265, or a complement thereof, where the highly stringently hybridizing polynucleotides encode a monooxygenase polypeptide capable of converting compound (1) to compound (2b) in enantiomeric excess.

In some embodiments, the polynucleotides encode the polypeptides described herein but have about 80% or more sequence identity, about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered monooxygenases described herein. In some embodiments, the reference polynucleotide is selected from the group consisting of SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, and 265.

An isolated polynucleotide encoding a polypeptide of the disclosure may be manipulated in a variety of ways to provide for expression of the polypeptide. In some embodiments, the polynucleotides encoding the polypeptides can be provided as expression vectors where one or more control sequences is present to regulate the expression of the polynucleotides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art. Guidance is provided in Sambrook et al., 2001, Molecular Cloning: A Laboratory Manual, 3rd Ed., Cold Spring Harbor Laboratory Press; and Current Protocols in Molecular Biology, Ausubel. F. ed., Greene Pub. Associates, 1998, updates to 2009, the disclosures of which are incorporated herein by reference.

In some embodiments, the control sequences include among others, promoters, leader sequences, polyadenylation sequences, propeptide sequences, signal peptide sequences, and transcription terminators. Suitable promoters can be selected based on the host cells used. Exemplary bacterial promoters include *E. coli* lac operon, *E. coli* trp operon, bacteriophage λ, *Streptomyces coelicolor* agarase gene (dagA), *Bacillus subtilis* levansucrase gene (sacB), *Bacillus licheniformis* alpha-amylase gene (amyL), beta-lactamase gene, and tac promoter. Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease, and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase.

In some embodiments, the control sequence may also be a signal peptide coding region that codes for an amino acid sequence linked to the amino terminus of a polypeptide and directs the encoded polypeptide into the cell's secretory pathway. The signal sequence typically depends on the type of host cell being used to express the polypeptide. Effective signal peptide coding regions for bacterial host cells are the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Exemplary signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells can be from the genes for *Saccharomyces cerevisiae* alpha-factor and *Saccharomyces cerevisiae* invertase.

Other control sequences, such as leader sequences, polyadenylation sequences, and transcription terminator sequences can use those available in the art (see Sambrook, supra, and Current Protocols in Molecular Biology, supra).

In another aspect, the present disclosure is also directed to a recombinant expression vector comprising a polynucleotide encoding an engineered monooxygenase polypeptide or a variant thereof, and one or more expression regulating regions such as a promoter and a terminator, a replication origin, etc., depending on the type of hosts into which they are to be introduced. The recombinant expression vector may be any vector (e.g., a plasmid, cosmid, or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. The expression vector preferably contains one or more selectable markers, which permit easy selection of transformed cells. A selectable marker is a gene the product of which provides for biocide or viral resistance, resistance to heavy metals, prototrophy to auxotrophs, resistance to chemical agents (e.g., antibiotics) and the like.

In another aspect, the present disclosure provides a host cell comprising a polynucleotide encoding an engineered monooxygenase polypeptide of the present disclosure, the polynucleotide being operatively linked to one or more control sequences for expression of the monooxygenase polypeptide in the host cell. Host cells for use in expressing the monooxygenase polypeptides encoded by the expression vectors of the present invention are well known in the art and include but are not limited to, bacterial cells, such as *E. coli, Lactobacillus, Streptomyces* and *Salmonella typhimurium* cells; fungal cells, such as yeast cells; insect cells such as *Drosophila* S2 and *Spodoptera* Sf9 cells; animal cells such as CHO, COS, BHK, 293, and Bowes melanoma cells; and plant cells. Exemplary host cells are *Escherichia coli* BL21 and W3110.

Appropriate culture mediums and growth conditions for the above-described host cells are well known in the art. Polynucleotides for expression of the monooxygenase may be introduced into host cells by various methods known in the art (e.g., electroporation, biolistic particle bombardment, liposome mediated transfection, calcium chloride transfection, and protoplast fusion).

In the embodiments herein, the monooxygenase polypeptides and nucleotides encoding such polypeptides can be prepared using methods commonly used by those skilled in the art. As noted above, the naturally-occurring amino acid sequence and corresponding polynucleotide encoding the cyclohexanone monooxygenase enzyme of *Acinetobacter* sp NCIMB9871 (represented herein as SEQ ID NO:2) is described in Chen et al., 1988, J. Bacteriol. 170 (2), 781-789 and Genbank Accession No. BAA86293.1 GI:6277322. In some embodiments, the parent polynucleotide sequence is codon optimized to enhance expression of the monooxygenase in a specified host cell.

The engineered monooxygenases can be obtained by subjecting the polynucleotide encoding the naturally occurring cyclohexanone monooxygenase to mutagenesis and/or directed evolution methods (e.g., Stemmer, 1994, Proc Natl Acad Sci USA 91:10747-10751; WO 95/22625; WO 97/0078; WO 97/35966; WO 98/27230; WO 00/42651; WO 01/75767 and U.S. Pat. No. 6,537,746; each of which is hereby incorporated by reference herein).

Other directed evolution procedures that can be used include, among others, staggered extension process (StEP), in vitro recombination (Zhao et al., 1998, Nat. Biotechnol. 16:258-261), mutagenic PCR (Caldwell et al., 1994, PCR Methods Appl. 3:S136-S140), and cassette mutagenesis (Black et al., 1996, Proc Natl Acad Sci USA 93:3525-3529). Mutagenesis and directed evolution techniques useful for the purposes herein are also described in the following references: Ling, et al., 1997, Anal. Biochem. 254(2):157-78; Dale et al., 1996, Methods Mol. Biol. 57:369-74; Smith, 1985, Ann. Rev. Genet. 19:423-462; Botstein et al., 1985, Science 229:1193-1201; Carter, 1986, "Site-directed mutagenesis," Biochem. J. 237:1-7; Kramer et al., 1984, Cell 38:879-887; Wells et al., 1985, Gene 34:315-323; Minshull et al., 1999, Curr Opin Chem Biol 3:284-290; Christians et al., 1999, Nature Biotech 17:259-264; Crameri et al., 1998, Nature 391:288-291; Crameri et al., 1997, Nature Biotech 15:436-438; Zhang et al., 1997, Proc Natl Acad Sci USA 94:45-4-4509; Crameri et al., 1996, Nature Biotech 14:315-319; and Stemmer, 1994, Nature 370:389-391. All publications are incorporated herein by reference.

In some embodiments, the clones obtained following mutagenesis treatment are screened for monooxygenases having a desired enzyme property. Measuring monooxygenase enzyme activity from the expression libraries can be performed using the standard techniques, such as separation of the product (e.g., by HPLC) and detection of the product by measuring UV absorbance of the separated substrate and products and/or by detection using tandem mass spectroscopy (e.g., MS/MS). Clones containing a polynucleotide encoding the desired polypeptides are then isolated, sequenced to identify the nucleotide sequence changes (if any), and used to express the enzyme in a host cell. Exemplary assays for monooxygenase activity are provided in Example 2.

Where the sequence of the polypeptide is known, the polynucleotides encoding the enzyme can be prepared by standard solid-phase methods, according to known synthetic methods, e.g., the phosphoramidite method described by Beaucage et al., 1981, Tet Lett 22:1859-69, or the method described by Matthes et al., 1984, EMBO J. 3:801-05. In some embodiments, fragments of up to about 100 bases can be individually synthesized, then joined (e.g., by enzymatic or chemical litigation methods, or polymerase mediated methods) to form any desired continuous sequence.

The polypeptides can be expressed in appropriate cells, and recovered from the host cells and or the culture medium using any one or more of the well known techniques used for protein purification, including, among others, lysozyme treatment, sonication, filtration, salting-out, ultra-centrifugation, and chromatography. Chromatographic techniques for isolation of the monooxygenase polypeptide include, among others, reverse phase chromatography high performance liquid chromatography, ion exchange chromatography, gel electrophoresis, and affinity chromatography.

Conditions for purifying a particular enzyme will depend, in part, on factors such as net charge, hydrophobicity, hydrophilicity, molecular weight, molecular shape, etc., and will be apparent to those having skill in the art. In some embodiments, the engineered monooxygenases can be expressed as fusion proteins with purification tags, such as His-tags having affinity for metals, or antibody tags for binding to antibodies, e.g., myc epitope tag.

The polypeptide of the disclosure can be prepared in the form of crude extracts, lyophizates, powders, isolated preparations, and substantially pure preparations, as further described below.

5.4 METHODS OF USE

In a further aspect, the monooxygenase polypeptides of the disclosure can be used in a process for conversion of various aryl-alkyl sulfide substrates to the corresponding sulfoxide. While the monooxygenase polypeptides herein are described with respect to the conversion of 5-methoxy-2-((4-methoxy-3,5-dimethylpyridin-2-yl)methylthio)-1H-benzo[d]imidazole (compound (1)) to 5-methoxy-2-((4-methoxy-3,5-dimethylpyridin-2-yl)methylsulfinyl)-1H-benzo[d]imidazole (compound (2)), the engineered monooxygenase polypeptides can be applied to the conversion of other prazole compounds structurally similar to pyrmetazole. Accordingly in some embodiments, the monooxygenase polypeptides of the disclosure can be used in a process for the conversion of the compound of structural Formula (I) to the product of Formula (II):

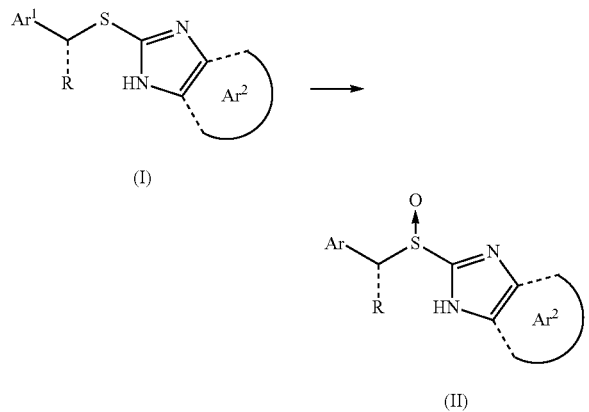

(I)

(II)

wherein, $Ar^1$ is an optionally substituted aryl or heteroaryl ring; R is H, a lower alkyl, a heteroalkyl, or forms a 5 to 8 membered cycloalkyl, heteroalkyl, aryl or heteroaryl fused ring with a ring carbon of $Ar^1$; and $Ar^2$ is an optionally substituted cycloalkyl, heterocycloalkyl, aryl, or heteroaryl ring fused to the imidazole ring.

In some embodiments, $Ar^1$ is an optionally substituted phenyl or pyridyl. In some embodiments, $Ar^1$ can have 1 to 5 substitutions, preferably 1, 2, or 3 substitutions. Substitutions in $Ar^1$ can be a substituted or unsubstituted: lower alkyl, lower alkoxy, amino or alkylamino group. In some embodiments, the substituted alkyl is a haloalkyl.

In some embodiments, $Ar^2$ is selected from an optionally substituted thienyl, phenyl or pyridyl. In some embodiments $Ar^2$ can have 1 to 5 substitutions, preferably 1, 2 or 3 substitutions. Substitutions in $Ar^1$ can be a substituted or unsubstituted: lower alkyl, lower alkoxy, or a 5 to 7 membered heterocycloalkyl, aryl or heteroaryl ring.

Prazole compounds that can be prepared by use of the monooxygenases described herein include, by way of example and not limitation, those shown in Table 4 below.

TABLE 4

| Compound Name | Prazole Compound Structure |
|---|---|
| Esomeprazole (or (S)-omeprazole) | |
| (R)-Omeprazole | |
| (R)- or (S)-Lansoprazole | |
| (R)- or (S)-Tenatoprazole | |

TABLE 4-continued
| Compound Name | Prazole Compound Structure |
| --- | --- |
| (R)- or (S)-Rabeprazole | 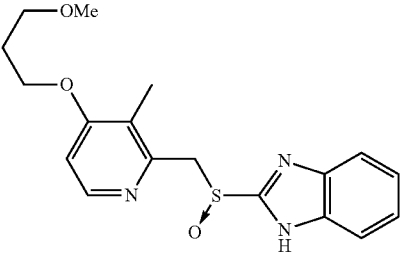<br>(R) or (S) |
| (R)- or (S)-Pantoprazole | 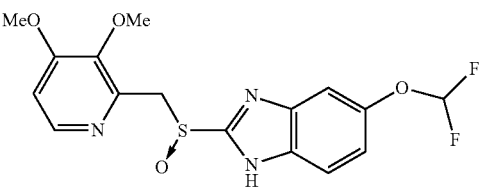<br>(R) or (S) |
| (R)- or (S)-Ilaprazole | 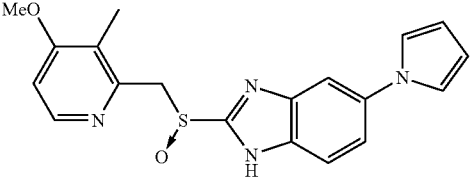<br>(R) or (S) |
| (R)- or (S)-Leminoprazole | 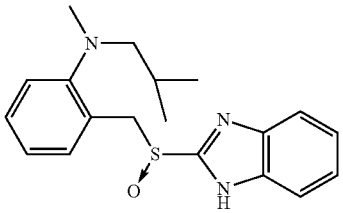<br>(R) or (S) |
| (R)- or (S)-Saviprazole | 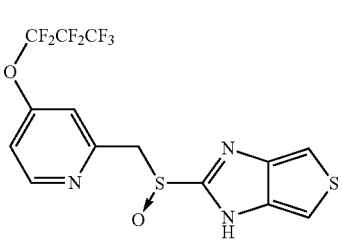<br>(R) or (S) |
| (R)- or (S)-TY-11345 | 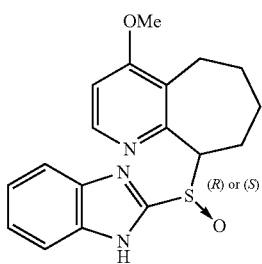 [SMILES: COc1ccnc2c1CCCCC2S(=O)c1nc2ccccc2[nH]1]<br>(R) or (S) |

In some embodiments, the process can comprise contacting or incubating the compound of formula (I) above with an engineered CHMO polypeptide described herein in presence of an electron donor under suitable reaction conditions to convert the compound of formula (I) to the product compound of formula (II). Suitable reaction conditions include a source of molecular oxygen ($O_2$), and the electron donor can be cofactor NADPH or NADH. In some embodiments, the $O_2$ can be $O_2$ dissolved in a reaction solution. The enantioselectivity of the process can be determined by measuring the amount of (R) and (S) products formed in the reaction. Exemplary polypeptides for use in the process can be a polypeptide comprising an amino acid sequence selected from the group consisting of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, and 266, or an engineered CHMO polypeptide that comprises an amino acid sequence having the set of amino acid differences relative to SEQ ID NO: 2 that are present in any one of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, or 266.

In some embodiments, the engineered CHMO polypeptide useful in the process can comprise an amino acid sequence at least 80%, 85%, 86%, 87%, 88%, 89%, 90%, 91%, 92%, 93%, 94%, 95%, 96%, 97%, 98%, 99%, or more identical to a reference sequence selected from the group consisting of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, or 266, and optionally further comprising an amino acid sequence having the set of amino acid differences relative to SEQ ID NO: 2 that are listed in Table 2A or 2B for any one of 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, or 266.

As described herein, in some embodiments, the monooxygenase polypeptides of the disclosure can be used in a process for the conversion of 5-methoxy-2-((4-methoxy-3,5-dimethylpyridin-2-yl)methylthio)-1H-benzo[d]imidazole ("pyrmetazole" or "compound (1)") to 5-methoxy-2-((4-methoxy-3,5-dimethylpyridin-2-yl)methylsulfinyl)-1H-benzo[d]imidazole ("R- and S-omeprazole" or "compound (2)"). In some embodiments, the process comprises contacting or incubating compound (1) with a polypeptide described herein in presence of a an electron donor, e.g., a cofactor, under suitable reaction conditions to convert compound (1) to compound (2).

In some embodiments, the monooxygenase polypeptides can be used in the conversion of compound (1) to compound (2a) in enantiomeric excess. In some embodiments, the process comprises contacting or incubating compound (1) with a R-enantioselective polypeptide described herein in presence of an electron donor, e.g., a cofactor, under suitable reaction conditions to convert the compound (1) to compound (2a) in enantiomeric excess. Exemplary polypeptides useful for the process can comprise an amino acid sequence selected from the group consisting of SEQ ID NO: 4, 6, 160, 162, 164, 166, 168, 170, 172, 174, 176, 178, 180, 182, 184, 186, 188, 190, 192, 194, 196, 198, 200, 202, 204, 206, and 208, or an engineered CHMO polypeptide that comprises an amino acid sequence having the set of amino acid differences relative to SEQ ID NO: 2 that are present in any one of SEQ ID NO: 4, 6, 160, 162, 164, 166, 168, 170, 172, 174, 176, 178, 180, 182, 184, 186, 188, 190, 192, 194, 196, 198, 200, 202, 204, 206, or 208.

In some embodiments, the monooxygenase polypeptides can be used in the conversion of compound (1) to compound (2b) in enantiomeric excess. In some embodiments, the process comprises contacting or incubating the compound (1) with a S-enantioselective polypeptide described herein in presence of an electron donor, e.g., a cofactor, under suitable reaction conditions to convert the compound (1) to compound (2b) in enantiomeric excess. Exemplary polypeptides useful for the process can comprise an amino acid sequence selected from SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266, or an engineered CHMO polypeptide that comprises an amino acid sequence having the set of amino acid differences relative to SEQ ID NO: 2 that are present in any one of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, or 266.

In some embodiments, the process comprises contacting or incubating the compound (1) with a S-enantioselective polypeptide described herein in presence of an electron donor, e.g., a cofactor, under suitable reaction conditions to convert the compound (1) to compound (2b) in at least 90% enantiomeric excess. Exemplary polypeptides useful for the process can comprise an amino acid sequence selected from SEQ ID NO: 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 242, 244, 248, 250, 254, 256, 258, 262, and 264, or an engineered CHMO polypeptide that comprises an amino acid sequence having the set of amino acid differences relative to SEQ ID NO: 2 that are present in any one of SEQ ID NO: 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 242, 244, 248, 250, 254, 256, 258, 262, or 264.

In some embodiments, the process comprises contacting or incubating the compound (1) with a polypeptide described herein in presence of an electron donor, e.g., a cofactor, under suitable reaction conditions to convert the compound (1) to compound (2b) in at least 99% enantiomeric excess. Exemplary polypeptides useful for this process can comprise an amino acid sequence selected from SEQ ID NO: 16, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 116, 120, 122, 124, 126, 128, 130, 132, 134, 136, 138, 140, 142, 144, 146, 148, 150, 152, 154, 156, and 158, or an engineered CHMO polypeptide that comprises an amino acid sequence having the set of amino acid differences relative to SEQ ID NO: 2 that are present in any one of SEQ ID NO: 16, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 116, 120, 122, 124, 126, 128, 130, 132, 134, 136, 138, 140, 142, 144, 146, 148, 150, 152, 154, 156, or 158.

In some embodiments, the monooxygenase polypeptides can be used in the preparation of an omeprazole analog compound of structural formula (II) in enantiomeric excess, wherein the compound of structural formula (II) is selected from: (R) or (S)-lansoprazole, (R) or (S)-tenatoprazole, (R) or (S)-rabeprazole, (R) or (S)-pantoprazole, (R) or (S)-ilaprazole, (R) or (S)-leminoprazole, (R) or (S)-saviprazole, and (R) or (S)-TY-11345. In such embodiments, process comprises contacting or incubating a sulfide precursor of structural formula (I) for the omeprazole analog compound (i.e., the corresponding pyrmetazole substrate analog compound) with a polypeptide described herein in presence of an electron donor (e.g., a cofactor) under suitable reaction conditions to convert the sulfide precursor compound of formula (I) to the omeprazole analog compound of structural formula (II).

In some embodiments, this process for preparing an omeprazole analog compound can be carried out wherein the sulfide precursor compound of formula (I) is 5-(difluoromethoxy)-2-((3,4-dimethoxypyridin-2-yl)methylthio)-1H-benzo[d]imidazole and the compound of formula (II) is (5)-pantoprazole which is produced in enantiomeric excess. In such embodiments, the process can be carried out wherein the polypeptide comprises an amino acid sequence selected from the group consisting of SEQ ID NO: 70, 72, 76, 78, 80, 82, 84, 86, 90, 92, 94, 96, 98, 100, 102, 104, 106, 108, 110, 112, 114, 116, 118, 120, 122, 126, 128, 130, 228, 232, 244, 248, 256, 258, 260, 262, and 264, or in which the polypeptide comprises an amino acid sequence having the set of amino acid differences relative to SEQ ID NO: 2 that are present in any one of ID NO: 70, 72, 76, 78, 80, 82, 84, 86, 90, 92, 94, 96, 98, 100, 102, 104, 106, 108, 110, 112, 114, 116, 118, 120, 122, 126, 128, 130, 228, 232, 244, 248, 256, 258, 260, 262, or 264.

In some embodiments, this process for preparing an omeprazole analog compound can be carried out wherein the sulfide precursor compound of formula (I) is 5-methoxy-2-((4-methoxy-3,5-dimethylpyridin-2-yl)methylthio)-1H-imidazo[4,5-b]pyridine and the compound of formula (II) is (S)-tenatoprazole, which is produced in enantiomeric excess. In such embodiments, the process can be carried out wherein the polypeptide comprises an amino acid sequence selected from the group consisting of SEQ ID NO: 66, 102, 104, 114, 122, 124, 128, 232, 238, 244, 260, 262, and 264, or in which the polypeptide comprises an amino acid sequence having the set of amino acid differences relative to SEQ ID NO: 2 that are present in any one of SEQ ID NO: 66, 102, 104, 114, 122, 124, 128, 232, 238, 244, 260, 262, or 264.

In some embodiments, this process for preparing an omeprazole analog compound can be carried out wherein the sulfide precursor compound of formula (I) is 2-((4-(3-methoxypropoxy)-3-methylpyridin-2-yl)methylthio)-1H-benzo[d]imidazole and the compound of formula (II) is (S)-rabeprazole, which is produced in enantiomeric excess. In such embodiments, the process can be carried out wherein the polypeptide comprises an amino acid sequence selected from the group consisting of SEQ ID NO: 62, 76, 84, 86, 124, 238, 240, 250, 258, 262, and 264, or in which the polypeptide comprises an amino acid sequence having the set of amino acid differences relative to SEQ ID NO: 2 that are present in any one of SEQ ID NO: 62, 76, 84, 86, 124, 238, 240, 250, 258, 262, or 264.

In some embodiments, this process for preparing an omeprazole analog compound can be carried out wherein the sulfide precursor compound of formula (I) is 2-((3-methyl-4-(2,2,2-trifluoroethoxy)pyridin-2-yl)methylthio)-1H-benzo[d]imidazole and the compound of formula (II) is (R)-lansoprazole which is produced in enantiomeric excess. In such embodiments, the process can be carried out wherein the polypeptide comprises an amino acid sequence of SEQ ID NO: 6, or in which the polypeptide comprises an amino acid sequence having the set of amino acid differences relative to SEQ ID NO: 2 that are present in SEQ ID NO: 6.

In some embodiments, the process is carried out at a reaction condition temperature of 10° C. to 50° C., and in particular 25° C. to 40° C. The temperature can be chosen to maximize the reaction rate at higher temperatures while maintaining the activity of the enzyme for sufficient duration for efficient conversion of the substrate to the product. Where higher temperatures are used, polypeptides with increased thermostability can be selected to carry out the process.

In some embodiments, the reaction condition comprises a pH of about 8.5 to a pH of about 10. In some embodiments, the reaction condition is a pH of about 8.5 to about 9. This slightly basic condition limits the degradation of the product compound (2) that occurs below about pH 8.5. During the course of the reaction, the pH of the reaction mixture may change. The pH of the reaction mixture may be maintained at a desired pH or within a desired pH range by the addition of an acid or a base during the course of the reaction. Alternatively, the pH may be controlled by using an aqueous solvent that comprises a buffer. Suitable buffers to maintain desired pH ranges are known in the art and include, for example, phosphate buffer, triethanolamine buffer, and the like. Combinations of buffering and acid or base addition may also be used. In some embodiments, the reaction condition comprises a phosphate buffer concentration of about 5 to 50 mM. At the lower phosphate buffer concentrations, NADPH is shown to have greater stability.

As noted above, the process described herein consumes molecular oxygen, i.e., $O_2$, where an oxygen atom is transferred to a sulfide to yield the sulfoxide. In some embodiments, the $O_2$ is dissolved in the reaction solution. Dissolved $O_2$ can be increased by direct sparging of $O_2$ gas into the reaction solution (e.g., U.S. Pat. No. 6,478,964), and/or by increasing the partial pressure of $O_2$ to pressures higher than the atmospheric pressure. In some embodiments, oxygenation of the reaction solution is done by a bubble-free process. For example, oxygen mass transfer across PTFE membrane for bubble free aeration is described in Schneider et al., 1995, Enzyme and Microbial Technology 17(9):839-847 and EPO 172478, incorporated herein by reference.

Generally, a cofactor is used in the reduction reaction. The cofactor operates in combination with the polypeptides of the disclosure in the process. Suitable cofactors include, but are not limited to, $NADP^+$ (nicotinamide adenine dinucleotide phosphate), NADPH (the reduced form of $NADP^+$), $NAD^+$ (nicotinamide adenine dinucleotide) and NADH (the reduced form of $NAD^+$). Generally, the reduced form of the cofactor is added to the reaction mixture. The reduced NAD(P)H form can be optionally regenerated from the oxidized $NAD(P)^+$ form using a cofactor regeneration system. In some embodiments of the process, a cofactor recycling system is used to regenerate cofactor NADPH/NADH form NADP+/NAD+ produced in the reaction.

In some embodiments of the process, an optional cofactor recycling system can be used to regenerate cofactor NADPH/NADH form NADP+/NAD+ produced in the reaction. A cofactor regeneration system refers to a set of reactants that participate in a reaction that reduces the oxidized form of the cofactor (e.g., $NADP^+$ to NADPH). Cofactors oxidized by the polypeptide reduction of the keto substrate are regenerated in reduced form by the cofactor regeneration system. Cofactor regeneration systems comprise a stoichiometric reductant that is a source of reducing hydrogen equivalents and is capable of reducing the oxidized form of the cofactor. The cofactor regeneration system may further comprise a catalyst, for example an enzyme catalyst that catalyzes the reduction of the oxidized form of the cofactor by the reductant. Cofactor regeneration systems to regenerate NADH or NADPH from $NAD^+$ or $NADP^+$, respectively, are known in the art and may be used in the methods described herein.

Suitable exemplary cofactor regeneration systems that may be employed include, but are not limited to, glucose and glucose dehydrogenase; formate and formate dehydrogenase; glucose-6-phosphate and glucose-6-phosphate dehydrogenase; an alcohol (e.g., isopropanol) and a ketoreductase/alcohol dehydrogenase; phosphite and phosphite dehydrogenase, molecular hydrogen and hydrogenase; and the like. These systems may be used in combination with either $NADP^+$/NADPH or $NAD^+$/NADH as the cofactor. Electrochemical regeneration using hydrogenase may also be used as a cofactor regeneration system. See, e.g., U.S. Pat. Nos. 5,538,867 and 6,495,023, both of which are incorporated herein by reference. Chemical cofactor regeneration systems comprising a metal catalyst and a reducing agent (for example, molecular hydrogen or formate) are also suitable. See, e.g., PCT publication WO 2000/053731, which is incorporated herein by reference.

In some embodiments, the cofactor recycling system can comprise glucose dehydrogenase (GDH), which is a $NAD^+$ or $NADP^+$-dependent enzyme that catalyzes the conversion of D-glucose and $NAD^+$ or $NADP^+$ to gluconic acid and NADH or NADPH, respectively. Glucose dehydrogenases suitable for use in the practice of the processes described herein include both naturally occurring glucose dehydrogenases, as well as non-naturally occurring glucose dehydrogenases. Naturally occurring glucose dehydrogenase encoding genes have been reported in the literature, e.g., the *Bacillus subtilis* 61297 GDH gene, *B. cereus* ATCC 14579 and *B. megaterium*. Non-naturally occurring glucose dehydrogenases generated using, for example, mutagenesis, directed evolution, and the like are provided in PCT publication WO 2005/018579, and US publication Nos. 2005/0095619 and 2005/0153417. All of these sequences are incorporated herein by reference.

In some embodiments, the co-factor regenerating system can comprise a formate dehydrogenase, which is a $NAD^+$ or NADV-dependent enzyme that catalyzes the conversion of formate and $NAD^+$ or $NADP^+$ to carbon dioxide and NADH or NADPH, respectively. Formate dehydrogenases that are suitable for use as cofactor regenerating systems in the monooxygenase reactions described herein include naturally occurring and non-naturally occurring formate dehydrogenases. Suitable formate dehydrogenases are described in PCT publication WO 2005/018579. Formate may be provided in the form of a salt, typically an alkali or ammonium salt (for example, $HCO_2Na$, $KHCO_2NH_4$, and the like), in the form of formic acid, typically aqueous formic acid, or mixtures thereof. A base or buffer may be used to provide the desired pH.

In some embodiments, the co-factor regenerating system can comprise a phosphite dehydrogenase, which catalyzes the conversion of phosphite and NAD" or NADP" to a phosphate and NADH or NADPH, respectively. Phosphite dehydrogenases that are suitable for use as cofactor regenerating systems in the processes described herein include naturally occurring and non-naturally occurring phosphite dehydrogenases. Naturally occurring phosphite dehydrogenases include those from, *Pseudomonas stutzeri* and *Alcaligenes faecalis*, and non-naturally occurring phosphite dehydrogenases include engineered phosphite dehydrogenases derived therefrom. Phosphite dehydrogenases are described in Johannes et al., 2005, Applied and Environmental Microbiology 71(10): 5728-5734; Woodyer et al., 2003, Biochemistry 42 (40): 11604-11614; Vrtis et al., 2002, Angewandte Chemie 41(17): 3257-3259; Johannes et al., 2006, Biotechnology and Bioengineering Volume 96(1):18-26; and McLachlan et al., 2008, Biotechnology and Bioengineering 99(2):268-274.

In some embodiments, the co-factor regenerating system can comprise an alcohol dehydrogenase or ketoreductase, which is an $NAD^+$ or $NADP^+$-dependent enzyme that catalyzes the conversion of an alcohol and $NAD^+$ or $NADP^+$ to an aldehyde or ketone and NADH or NADPH, respectively. Alcohol dehydrogenases and ketoreductases that are suitable for use as cofactor regenerating systems in the processes described herein include naturally occurring and non-naturally occurring alcohol dehydrogenases and ketoreductases. Naturally occurring alcohol dehydrogenases include known alcohol dehydrogenase/ketoreductase from, among others, *Thermoanerobium brockii, Rhodococcus erythropolis, Saccharomyces cerevisiae, Lactobacillus kefiri, Lactobacillus minor*, and *Lactobacillus brevis*, and non-naturally occurring alcohol dehydrogenase/ketoreductase include engineered alcohol dehydrogenase/ketoreductase derived therefrom. In some embodiments, non-naturally occurring alcohol dehydrogenase/ketoreductases engineered for thermo- and solvent stability can be used. Such alcohol dehydrogenases/ketoreductases are described in patent publications US 20080318295; 20090093031; 20090191605; US 20090155863; and US 20090162909; all of which are incorporated by reference herein.

Suitable alcohols include lower secondary alkanols and aryl-alkyl carbinols. Examples of lower secondary alcohols include isopropanol, 2-butanol, 3-methyl-2-butanol, 2-pentanol, 3-pentanol, 3,3-dimethyl-2-butanol, and the like. In one embodiment, the secondary alcohol is isopropanol. Suitable aryl-alkyl carbinols include unsubstituted and substituted 1-arylethanols.

In some embodiments where the cofactor recycling system produces a volatile product, such as acetone from isopropanol, the volatile product can be removed by sparging the reaction solution with a non-reactive gas or by applying a vacuum to lower the reaction pressure and removing the volatile present in the gas phase. A non-reactive gas is any gas that does not react with the reaction components. Various non-reactive gases include nitrogen and noble gases (e.g., inert gases). In some embodiments, the non-reactive gas is nitrogen gas. For example, acetone formed by oxidation of isopropanol can be removed by sparging with nitrogen gas or applying a vacuum to the reaction solution and removing the acetone from the gas phase by an acetone trap, such as a condenser or other cold trap.

In the embodiments herein, the polypeptides for carrying out the conversion of pyrmetazole to esomeprazole and any enzymes comprising the optional cofactor regeneration system, may be added to the reaction mixture in the form of the purified enzymes, whole cells transformed with gene(s) encoding the enzymes, and/or cell extracts and/or lysates of such cells. The gene(s) encoding the polypeptides disclosed herein and the optional cofactor regeneration enzymes can be transformed into host cells separately or together into the same host cell. Whole cells transformed with gene(s) encoding the engineered ketoreductase enzyme and/or the optional cofactor regeneration enzymes, or cell extracts and/or lysates thereof, may be employed in a variety of different forms, including solid (e.g., lyophilized, spray-dried, and the like) or semisolid (e.g., a crude paste).

The processes described herein are generally carried out in an aqueous solvent (e.g., water, buffer, and salts). In some embodiments, aqueous solvents, including water and/or co-solvent systems, are used. Co-solvents can reduce the formation of aggregates which can affect the rate and scalability of the process. At substrate loading of 75 g/L or higher, the use of a co-solvent is desirable. Suitable co-solvents include: MeOH, EtOH, isopropanol (IPA), acetone, toluene, MeCN, methyl tert-butyl ether (MTBE), N-methyl-2-pyrrolidone (NMP), dimethylacetamide (DMAc), dimethylformamide (DMF), propylene glycol, polyethylene glycol (PEG), tetramethylurea, N-ethylpyrrollidinone, tetraglyme, 1,3-Dimethyl-3,4,5,6-tetrahydro-2(1H)-pyrimidinone (DMPU), DMIU, hexamethylphosphoramide (HMPA) and dimethylsulfoxide (DMSO). Choice of co-solvent can be based on evaluating a combination of factors including: compound solubility, compound stability, reaction/process safety, toxicity, allowable level of solvent in the product (e.g., an API product); the effectiveness of the co-solvent in preventing agglomeration of the product, and stability of the monooxygenase to the co-solvent. NMP is a particularly suitable co-solvent for reactions with substrate loading of 100 g/L.

The order of addition of reactants is not critical. The reactants may be added together at the same time to a solvent (e.g., monophasic solvent, biphasic aqueous co-solvent system, and the like), or alternatively, some of the reactants may be added separately, and some together at different time points.

In the processes herein, the reaction is generally allowed to proceed until essentially complete, or near complete, conversion of compound (1) with a polypeptide described herein under suitable reaction conditions to convert the compound (1) to compound (2b) is obtained. Conversion of substrate to product can be monitored using known methods by detecting substrate and/or product. Suitable methods include gas chromatography, HPLC, and the like.

6. EXAMPLES

Various features and embodiments of the disclosure are illustrated in the following representative examples, which are intended to be illustrative, and not limiting.

Example 1

Wild-Type Cyclohexanone Monooxygenase (CHMO) Gene Acquisition and Construction of Expression Vectors The gene encoding the wild type cyclohexanone monooxygenase (CHMO) from *Acinetobacter* sp NCIMB9871 (SEQ ID NO: 2) was designed for expression in *E. coli* using standard codon optimization to yield the nucleotide sequence of SEQ ID NO: 1. (Standard codon-optimization software is reviewed in, e.g., "OPTIMIZER: a web server for optimizing the codon usage of DNA sequences," Puigbo et al., Nucleic Acids Res. 2007 July; 35(Web Server issue): W126-31. Epub 2007 Apr. 16.) The optimized gene was synthesized using oligonucleotides composed of 42 nucleotides and cloned into expression vector pCK110900 (which is depicted as FIG. 3 in US Patent Application Publication 20060195947, which is hereby incorporated by reference herein) under the control of a lac promoter. The pCK110900 expression vector also contained the P15a origin of replication and the chloramphenicol resistance gene. The resulting plasmid was transformed into *E. coli* W3110 using standard methods.

Directed evolution of the codon-optimized wild-type CHMO gene was carried out through multiple rounds resulting in variant polynucleotides encoding engineered CHMO polypeptides having improved enzyme properties. These variant polynucleotides were cloned into vector pCK110900 for expression in *E. coli* W3110 according to the same procedures described above for the wild type gene. The variant CHMO nucleotide and amino acid sequences resulting from directed evolution are listed in the Sequence Listing incorporated by reference herein. The amino acid residue differences and altered enzyme properties of these engineered CHMO polypeptides are summarized in Tables 2A and 2B (above) and Tables 6, 7, 13, 16, and 19 of the Examples below.

Example 2

Assay Procedures for Engineered CHMO Polypeptides (a) High-Throughput Activity Assay This example illustrates a high throughput spectrophotometric assay in 96-well plate format that is used to assay relative activity of engineered CHMO polypeptides (as in Table 2A). This assay can also be used for real-time monitoring of bioprocesses using these polypeptides.

The substrate, pyrmetazole (6 g/L), ketoreductase of SEQ ID NO: 268 (cofactor recycling enzyme) (1 g/L) and cofactor (0.1 g/L) were dissolved in 300 µL volume of buffer (pH 9.0) with 8% isopropanol (IPA), 2% acetone and 15% N-methyl-2-pyrrolidone (NMP) in the wells of a 96-well plate. Cell lysate from a directed evolution sample or bioprocess sample containing the engineered CHMO polypeptide (3.3% of total reaction volume) was then added to the reaction mixture. Plates also contained negative control wells (empty vector) which provide background reaction levels.

The reaction was shaken at ambient temperature for 24 h (or 0.5 h can be used for real-time monitoring of bioprocess) then quenched by dilution with 3.33 volumes of acetonitrile and mixed thoroughly to give a total 4.3-fold dilution. The quenched mixture is centrifuged at 4000 rpm for 10 min. A sample of the quenched mixture was then transferred to an empty 96 well plate. The plate was analyzed with chromatographic method by high performance liquid chromatography (HPLC) at 250 nm. The assay conditions are summarized in Table 5 below.

TABLE 5

HTP activity assay conditions

| Chemicals/Reagents | Amount |
|---|---|
| Substrate | 6 g/L |
| Cofactor (NADP+) | 0.1 g/L |
| Coenzyme (ketoreductase of SEQ ID NO: 268) | 1 g/L |
| Buffer (potassium phosphate, pH 9.0) | 75% (v/v) |
| Co-substrate (IPA) | 10% (v/v) |
| Co-solvent (acetone) | 2% (v/v) |
| Co-solvent (NMP) | 15% (v/v) |
| Cell lysate Volume | 3.3% |
| Reaction Volume | 300 µL |
| Reaction Temperature | Ambient |

The percentage conversion of the substrate pyrmetazole to esomeprazole product was calculated based on substrate and product peak area obtained from HPLC chromatography as follows: Percent Conversion=Product peak*Relative response factor/(Substrate peak area*Response factor+Product peak*Response factor)*100%.

(b) Thermal Stability Assay.

The substrate, pyrmetazole (6 g/L), ketoreductase (KRED) of SEQ ID NO: 268 (1 g/L) and NADP$^+$ (0.1 g/L) were dissolved in 300 µL volume of buffer (pH 9.0) with 8% IPA and 2% acetone in the wells of a 96-well plate. Cell lysate from a directed evolution or bioprocess sample containing the engineered CHMO polypeptide (5% of total reaction volume) was then added to the reaction mixture. Plates also contained negative control wells (empty vector) which provide background reaction levels.

The reaction was shaken at 32° C. for 24 hrs, then quenched by dilution with 3.3 volumes of acetonitrile and mixed thoroughly to give a total 4.3-fold dilution. The quenched mixture was centrifuged at 4000 rpm for 10 min. A sample of the quenched mixture was then transferred to an empty 96 well plate. The plate was analyzed with chromatographic method by HPLC at 250 nm.

(c) Assay of Sulfone Production

The product, esomeprazole (1 g/L), KRED (1 g/L) and NADP$^+$ (0.1 g/L) were dissolved in 300 µL volume of buffer (pH 9.0) with 8% IPA and 2% acetone in the wells of a 96-well plate. Cell lysate from a directed evolution or bioprocess sample containing the engineered CHMO polypeptide (60% of total reaction volume) was then added to the reaction mixture. Plates also contained negative control wells (empty vector) which provided background reaction levels.

The percentage conversion of esomeprazole product to sulfone-byproduct of compound (3) was calculated based on esomeprazole and sulfone-byproduct peak areas obtained from HPLC chromatography as follows: Percent Conversion=Sulfone peak area*Response factor/(Esomeprazole peak area*Response factor+Sulfone peak area*Relative response factor)*100.

(d) Determination of Enantiomeric Excess (% ee)

The substrate, pyrmetazole (2 g/L), KRED (1 g/L) and NADP$^+$ (0.1 g/L) were dissolved in 300 µL volume of buffer (pH 9.0) with 8% IPA and 2% acetone in the wells of a 96-well plate. Cell lysate from a directed evolution or bioprocess sample containing the engineered CHMO polypeptide (60% of total reaction volume) was then added to the reaction mixture. Plates also contained negative controls (empty vector) which provided the background reaction levels.

The percent enantiomeric excess of esomeprazole (or (S)-omeprazole) product was calculated based on (S)-omeprazole and (R)-omeprazole peak areas obtained from HPLC chromatography as follows: Enantiomeric excess=(R)-omeprazole peak area−(S)-omeprazole peak area/((R)-omeprazole peak area+(S)-omeprazole peak area)×100%. By convention throughout the present disclosure, however, the % ee values favoring the (S)-enantiomers have been designated as positive, whereas the % ee values favoring the (R)-enantiomers have been designated as negative.

Example 3

Production of Engineered CHMO Polypeptide Shake Flask Powders

This example illustrates production and assay of "shake flask powders" of engineered CHMO polypeptides. Shake flask powders include approximately 30% total protein and accordingly provide a more purified preparation of an engineered enzyme as compared to the cell lysate used in the high throughput assay of Example 2.

A single microbial colony of *E. coli* containing a plasmid encoding an engineered CHMO gene of interest was inoculated into 50 mL Luria Bertani broth containing 30 µg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM MgSO$_4$) containing 30 µg/mL chloramphenicol, in a 1 L flask to an optical density of 0.2 at 600 nm (OD$_{600}$) and allowed to grow at 30° C. Expression of the CHMO gene was induced by addition of isopropyl-β-D-thiogalactoside (IPTG) to a final concentration of 1 mM when the OD$_{600}$ of the culture is 0.6 to 0.8, and incubation was then continued overnight (at least 16 hours).

Cells were harvested by centrifugation (5000 rpm, 15 min, 4° C.) and the supernatant discarded. The cell pellet was resuspended with an equal volume of cold (4° C.) 25 mM phosphate buffer, pH 9.0, and harvested by centrifugation as above. The washed cells were resuspended in two volumes of the cold phosphate buffer and passed through a French Press twice at 12,000 psi while maintained at 4° C. Cell debris was removed by centrifugation (9000 rpm, 45 minutes, 4° C.). The clear lysate supernatant was collected and stored at −20° C. Lyophilization of frozen clear lysate provided a dry shake-flask powder of CHMO polypeptide. Alternatively, the cell pellet (before or after washing) was stored at 4° C. or −80° C.

Assays of activity, sulfone-byproduct production, and thermal stability were carried out as describe as in Example 2 except that the following reagents/conditions were used: 1-10 g/L shake flask powder of monooxygenase enzyme; 10-100 g/L pyrmetazole substrate; 1 g/L KRED coenzyme; 0.2-0.5 g/L NADP+ cofactor; 4% IPA; 96% phosphate buffer (pH 9); reaction temperature: room temperature; reaction time: 24 hr. Assay results for shake flask powder preparations of exemplary engineered CHMO polypeptides are shown below in Table 6.

TABLE 6

| SEQ ID NO: (nt/aa) | Activity FIOP[1] | % ee | Relative reduction in % Sulfone-byproduct[2] | Activity FIOP at 32° C. (thermal stability) |
|---|---|---|---|---|
| 9/10 | + | | | |
| 11/12 | + | | | |
| 15/16 | + | | | |
| 21/22 | + | 95.6 | | |
| 23/24 | + | | | |
| 25/26 | + | | | |
| 27/28 | + | | | |
| 29/30 | + | | | |
| 31/32 | ++ | 96.8 | | |
| 33/34 | ++ | | | |
| 35/36 | ++ | 97.5 | | |
| 37/38 | ++ | 97.4 | | |
| 39/40 | + | 96.2 | | |
| 41/42 | ++ | 97.4 | | |
| 43/44 | + | 96.5 | | |
| 45/46 | + | | | |
| 47/48 | + | | | |
| 49/50 | ++ | | | |
| 51/52 | ++ | 98.7 | 1.000 | |
| 53/54 | +++ | | 0.600 | |
| 55/56 | ++ | | | |
| 57/58 | +++ | 98.3 | 0.800 | |
| 59/60 | +++ | 98.3 | 0.800 | |
| 61/62 | +++ | 98.3 | 0.800 | |
| 63/64 | +++ | 98.3 | 0.800 | |
| 65/66 | ++ | 94.4 | 2.000 | |
| 67/68 | ++ | 94.4 | 2.000 | |
| 69/70 | +++ | | 0.640[3] | |
| 71/72 | +++ | | 0.560 | |
| 73/74 | +++ | | 0.720[3] | |
| 75/76 | +++ | 98.3 | 0.224[3] | |
| 77/78 | +++ | | | 1.7 |
| 79/80 | +++ | | | |
| 81/82 | +++ | | | |
| 83/84 | +++ | 98.3 | 0.067[3] | 1 |
| 85/86 | +++ | 99.4 | 0.090[3] | |
| 87/88 | +++ | 99.3 | 0.045[3] | |
| 89/90 | +++ | 99.0 | 0.022[3] | |
| 91/92 | ++++ | 98.6 | 0.090[3] | |
| 93/94 | ++ | 99.6 | 0.072[3] | |
| 95/96 | ++++ | 99.7 | 0.027[3] | |
| 97/98 | ++++ | 99.7 | 0.036[3] | |
| 99/100 | ++++ | 99.8 | 0.036[3] | |
| 101/102 | ++++ | 99.6 | 0.090[3] | |
| 103/104 | ++++ | 99.7 | 0.045[3] | |
| 105/106 | +++ | 99.8 | 0.007[3] | |
| 107/108 | +++++ | 99.8 | 0.007[3] | |
| 109/110 | ++++ | 99.8 | 0.007[3] | |
| 111/112 | ++++ | 99.8 | 0.007[3] | |
| 113/114 | +++++ | 99.7 | 0.036[3] | |
| 115/116 | ++++ | 99.6 | 0.014[3] | |
| 117/118 | ++++ | 99.8 | 0.014[3] | |
| 119/120 | ++++ | 99.6 | 0.007[3] | |
| 121/122 | +++ | 99.4 | 0.014[3] | |
| 123/124 | +++++ | | 0.007[3] | |
| 125/126 | +++++ | | 0.007[3] | |
| 127/128 | +++++ | | 0.007[3] | |
| 129/130 | +++++ | | 0.007[3] | |
| 131/132 | ++++++ | | | 0.8[4] |
| 133/134 | +++++ | | | 1.5[4] |
| 135/136 | +++++ | | | |
| 137/138 | ++++++ | | | |
| 139/140 | ++++++ | | | |
| 141/142 | +++++ | | | |
| 143/144 | ++++++ | | | 1.2[5] |
| 145/146 | ++++++ | | | 0.7[5] |
| 147/148 | ++++++ | | | |
| 149/150 | ++++++ | | | 1.3[5] |
| 151/152 | ++++++ | | | 1.3[5] |
| 153/154 | ++++++ | | | 1.3 |
| 155/156 | ++++++ | | | |
| 157/158 | ++++++ | | | |

[1]Except where noted, the engineered CHMO polypeptide of SEQ ID NO: 10 was used as the "parent" reference sequence for purposes of calculating "FIOP"

[2]Values for relative reduction in % sulfone-byproduct of compound (3) are relative to the value measured for the polypeptide of SEQ ID NO: 52 which yielded 72% conversion of pyrmetazole substrate to esomeprazole with only 1.9% sulfone-byproduct formation in a 24-hour reaction using 10 g/L pyrmetazole; 2.5 g/L CHMO polypeptide; 1 g/L KRED; 0.5 g/L NADPH; 4% v/v IPA; T = 26-28° C.

[3]Thermostability assay carried out at 35° C. in solution including 15% NMP.

[5]Thermostability assay carried out at 35° C.

+ = ≥1 fold
++ = ≥10 fold
+++ = ≥50 fold
++++ = ≥100 fold
+++++ = ≥200 fold
++++++ = ≥500 fold

Example 4

Fermentation Procedure for Production of Engineered CHMO Polypeptide DSP Powders This example illustrates production and assay of downstream processed ("DSP") powders of engineered CHMO polypeptides. DSP powders include approximately 80% total protein and accordingly provide a more purified preparation of an engineered enzyme as compared to the cell lysate used in the high throughput assay of Example 2.

Bench-scale fermentations of engineered CHMO polypeptides were carried out at 37° C. in batch phase and at 30° C. during expression phase in an aerated, agitated 15 L fermentor using 6.0 L of growth medium (0.88 g/L ammonium sulfate, 0.98 g/L of sodium citrate; 12.5 g/L of dipotassium hydrogen phosphate trihydrate, 6.25 g/L of potassium dihydrogen phosphate, 3.33 g/L of Tastone-154 yeast extract, 0.083 g/L ferric ammonium citrate, and 8.3 ml/L of a trace element solution containing 2 g/L of calcium chloride dihydrate, 2.2 g/L of zinc sulfate heptahydrate, 0.5 g/L manganese sulfate monohydrate, 1 g/L cuprous sulfate pentahydrate, 0.1 g/L ammonium molybdate tetrahydrate and 0.02 g/L sodium tetraborate). The fermentor was inoculated with a late exponential culture of E. coli W3110 containing the plasmid encoding the engineered CHMO gene of interest (grown in a shake flask as described in Example 3) to a starting $OD_{600}$ of 0.5 to 2.0. The fermentor was agitated at 500-1500 rpm with air supplied to the fermentation vessel at 2.0-30 L/min to maintain a dissolved oxygen level of 55% saturation or greater. The pH of the culture was maintained at 7.0 by addition of 28% v/v ammonium hydroxide. Growth of the culture was maintained by addition of a feed solution containing 500 g/L dextrose monohydrate, 12 g/L ammonium chloride and 5 g/L magnesium sulfate heptahydrate. After the feed volume reaches 1000 mL expression of the CHMO polypeptide was induced by addition of IPTG to a final concentration of 1 mM and fermentation continued for another 18 hours. The culture was then chilled to 4° C. and maintained at that temperature until harvested. Cells were collected by centrifugation at 6600 G for 30 minutes at 4° C. Harvested cells were used directly in the downstream recovery process or stored at −20 until such use.

The cell pellet was resuspended in 2 volumes of 25 mM sodium phosphate buffer, pH 7.0 at 4° C. to each volume of wet cell paste. By using 1N sodium hydroxide pH has to be adjusted to 7.0 before lysis. Intracellular CHMO polypeptide was released from the cells by passing the suspension through a homogenizer fitted with a two-stage homogenizing valve assembly using a pressure of 12000 psig. The cell homogenate was collected in chilled container which was kept in ice bath immediately after disruption. Lysate pH has to be adjusted to 7.0 by using 1N sodium hydroxide A solution of 11% w/v polyethyleneimine, pH 7.2, was added to the lysate to a final concentration of 0.5% w/v and stirred for 30 minutes at 600 rpm at temperature of 25° C. to 30° C. The resulting suspension was clarified by centrifugation at 6600 G in a standard laboratory centrifuge for 60 minutes at 4-8° C. The clear decanted supernatant was cooled to 4-8° C. and pH adjusted to 7.0 by using 1N NaOH then concentrated ten-fold using a cellulose ultrafiltration membrane with a molecular weight cut off of 30 KDa at a temperature of 10° C. The final concentrate was dispensed into Petri plates, frozen at −20° C. and lyophilized for 48 h to provide the DSP powder. The DSP powder was then transferred to polyethene bags and stored at −20° C.

Assays of activity, sulfone-byproduct production, and thermal stability are carried out generally as described in Example 2 except that the following reagents/conditions are used: 1-10 g/L DSP powder of engineered CHMO polypeptide; 10-100 g/L pyrmetazole substrate; 1 g/L KRED coenzyme; 0.2-0.5 g/L NADP+ cofactor; 4% IPA; 96% phosphate buffer (pH 9); reaction temperature: room temperature; reaction time: 24 hr. Assay results for DSP powder preparations of engineered CHMO polypeptides are shown below in Table 7.

TABLE 7

| SEQ ID NO: (nt/aa) | Activity FIOP[1] | % ee of S-isomer | Relative Reduction in % Sulfone-byproduct[3] | Thermal Stability FIOP (50° C.) |
|---|---|---|---|---|
| 17/18 | + | | | |
| 31/32 | + | 96.5 | | |
| 35/36 | + | | | 25 |
| 51/52 | ++ | | | |
| 57/58 | ++ | | 1.0 | 30 |
| 71/72 | ++ | | 0.6 | 27 |
| 75/76 | ++ | 97.8 | 0.2 | 34 |
| 85/86 | ++ | 99.7 | 0.4 | 40 |
| 99/100 | +++ | 99.8 | 0.2 | 34 |
| 107/108 | +++ | | 0.1 | 37 |
| 123/124 | ++++[2] | | (0.1%)[4] | 43 |
| 137/138 | ++++[2] | 99.8 | | |
| 157/158 | ++++[2] | 99.8 | | |

[1]Except where noted, SEQ ID NO: 18 used as "parent" for purposes of calculating "FIOP".
[2]Assay carried out as described above with addition of 10% NMP in reaction solution.
[3]Values for relative reduction in % sulfone-byproduct of compound (3) are relative to the value measured for the polypeptide of SEQ ID NO: 57 which yielded 73% conversion of pyrmetazole substrate to esomeprazole with only 2% sulfone-byproduct formation in a 24-hour reaction using 10 g/L pyrmetazole; 2.5 g/L CHMO polypeptide DSP powder; 1 g/L KRED; 0.5 g/L NADPH; 4% v/v IPA; T = 26-28° C.
[4]Value for the CHMO polypeptide SEQ ID NO: 124 is the absolute amount of % sulfone-byproduct measured in the 100 g/L substrate loading process described in Example 5.
+ = ≥1 fold
++ = ≥10 fold
+++ = ≥50 fold
++++ = ≥100 fold Example 5

Process for Production of Esomeprazole Using Engineered CHMO Polypeptides

This example illustrates processes at two substrate loadings and a product workup procedure for preparing esomeprazole ((S)-5-methoxy-2-((4-methoxy-3,5-dimethylpyridin-2-yl)methylsulfinyl)-1H-benzo[d]imidazole or "compound (2b)") in enantiomeric excess by contacting the pyrmetazole substrate compound (1) with an engineered CHMO polypeptide of the disclosure (e.g., the polypeptides of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78. 80. 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, or 266).

a. Exemplary Process Using 33 g/L Pyrmetazole Substrate Loading

In a 25 mL vial 360 mg of pyrmetazole were suspended in 8.52 mL of buffer solution (50 mM phosphate buffer at pH=9.0). Consecutively 0.48 mL of IPA, 6 mg of NADP in 1 mL of buffer solution, 12 mg of KRED in 1 mL of buffer solution and 12 mg of engineered CHMO polypeptide (SEQ ID NO: 100) in 1 mL of buffer solution were added. The reaction mixture was stirred at 700 rpm in an oxygen atmosphere at room temperature (~25° C.) with conversion periodically monitored by HPLC. After 24 h, 99% conversion of substrate to the esomeprazole product was obtained with only 0.9% of sulfone-byproduct present. The esomeprazole product was the S-enantiomer in excess with an ee of 99.83%.

b. Exemplary Process Using 100 g/L Pyrmetazole Substrate Loading

Reaction:

In a round bottom flask with overhead stirring 7.5 g of pyrmetazole substrate was suspended in 47.5 mL of buffer solution (50 mM phosphate buffer at pH=9.0) and 7.5 mL of NMP was added. The mixture was degassed and filled with oxygen 4 times prior to the addition of 3 mL of IPA. Consecutively, 15 mg of NADP in 2 mL of buffer solution (0.2 g/L), 75 mg of KRED in 10 mL of buffer solution (1 g/L) and 37.5 mg of engineered CHMO polypeptide (SEQ ID NO: 124) in 5 mL of buffer solution (0.5 g/L) were added. The reaction mixture was a slurry that was stirred at 250 rpm for 24 h at room temperature (~25° C.) in an oxygen atmosphere. The conversion of substrate to product was monitored periodically by HPLC. After 24 h, 23% of pyrmetazole substrate was converted to esomeprazole. Further addition of 150 mg (2 g/L) engineered CHMO polypeptide, 75 mg (1 g/L) KRED and 15 mg (0.2 g/L) NADP as solids 5 times over the course of a full reaction time of 69 h provides a final substrate conversion of 99.6%.

Product Workup:

The pH of the reaction mixture was adjusted to pH=7.9 and while stirring the slurry gets diluted with 75 mL of cold water (pH=8). The mixture was stirred for additional 20 min at 4° C. and was filtered. The residue was washed with additional 75 mL of ice cold water to provide a brownish filter cake as product. The product was dried at 2-3 mbar and 40° C. to provide 7.7 g (98% yield) of crude material. HPLC analysis indicates that the crude material was 97.8% pure esomeprazole with only 0.2% sulfone-byproduct of compound (3) and 1.5% pyrmetazole substrate. The esomeprazole product was the S-enantiomer in excess with an ee of 99.9%.

Example 6

Process for Production of Esomeprazole at 30 g Scale Using an Engineered CHMO Polypeptide This example illustrates a process for preparing esomeprazole in enantiomeric excess at a 30 g scale via a biocatalytic conversion of the substrate pyrmetazole using an engineered CHMO polypeptide of the disclosure (e.g., a polypeptide of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78. 80. 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, or 158).

A. Biocatalytic Reaction Protocol:

A 1 L multi-neck jacketed reactor vessel equipped with baffle and overhead stirrer, fitted with an anchor shaped agitator was charged with a pre-mixed powder of 30 g pyrmetazole (from Sinojie (HK) Ltd.) and 1.5 g of an esomeprazole "seed" (prepared in a previous enzymatic reaction), and then 517 mL of 0.05 M potassium phosphate at pH 9.0 ("buffer solution"). This reaction mixture was stirred at 150 rpm at 25° C. for 10 min in order to obtain a well-suspended slurry. A three way tap was attached to the necks of the vessel. The tap was fitted with 2 rubber balloons filled with oxygen and a vacuum line for conducting degassing steps prior to the start of the reaction. Vacuum was applied to the vessel (30 mbar, obtained within 5 min) and the evacuated flask was filled with oxygen via the three way tap. This evacuation-gas-filling cycle was repeated two more times. The reaction vessel under positive oxygen pressure then was charged sequentially with the following: 24 mL IPA (HPLC grade); 60 mg NADP in 4 mL buffer solution (pH 9.0); 300 mg ketoreductase of SEQ ID NO: 268 in 15 mL buffer solution (pH 9.0); 600 mg CHMO of SEQ ID NO: 158 in 40 mL buffer solution (pH 9.0); and 1.2 mL of catalase (*Aspergillus niger* catalase solution in buffer stabilized with sodium chloride and sorbitol with stated activity of 25000 CIU/g; available from Sigma-Aldrich). Catalase is added to neutralize peroxide that may form during the reaction and negatively affect the performance of the CHMO. The above reaction mixture was stirred at 25° C. for 48 hours. The stir rate was 300 rpm in the beginning and increased stepwise as shown in Table 8 below. The course of the reaction was followed by taking periodic ~0.3 mL samples from the reaction mixture which were quenched in 10 mL MeOH and analyzed using HPLC as described below. For the purpose of tracking the process, t=0 was set at the time at which the CHMO was added. Samples were also taken and tested for peroxide during course of reaction but no peroxide was detected. The in-process reaction profile based on the sample analyzes is summarized in Table 8 below. A % conversion of >99% within 36 hours can be estimated from the kinetic profile of the reaction. In comparable runs a conversion of ~98% was determined after 32 h (with a rate of conversion of ~1%/h constantly at the latter stage of the reaction) and similar kinetic profile could be obtained in repetitive runs with the described experimental set-up. The reaction mixture 48 hours after start was taken for product work-up and isolation as described below.

TABLE 8

Reaction Profile

| Time (h) | % Conversion | Stirring speed (rpm) |
|---|---|---|
| 0 | 5 | 300 |
| 2 | 17.6 | 350 |
| 4 | 30.7 | 350 |
| 6 | 43.3 | 350 |
| 7.5 | 50.1 | 400 |
| 22.5 | 87.8 | 450 |
| 26 | 92.3 | 450 |
| 28 | 94.3 | 450 |
| 30 | 96.1 | 450 |
| 44 | 99.6 | 450 |

B. Reaction Work-Up Protocol:

To the reaction mixture was added 165 mL (5.5 volumes) of methyl isobutyl ketone ("MIBK"), the jacket temperature was adjusted to 48° C. and the mixture was stirred at 300 rpm. After 25 min the internal temperature showed 45° C. and the slurry was completely dissolved. Mixing was stopped and after 20 min the phases were separated. The lower aqueous layer was slightly turbid with a yellowish color. The upper organic layer appeared to be an emulsion and was brown in color. The aqueous layer was drained and collected. The organic layer was subsequently drained and submitted to a warm filtration over Celite applying vacuum (the temperature of the jacket filter was adjusted to 45° C.). The aqueous phase was transferred back to the heated vessel and 45 mL of MIBK was added. Stirring at 300 rpm for 30 min and phase separation within 20 min afforded a lower slightly turbid, yellowish aqueous layer and a brownish upper organic phase. The aqueous layer was drained and discarded. The organic layer was drained and collected. The solution was submitted to warm Celite filtration after the first filtration was completed (same filter and Celite layer). The organic phases were combined and separated from the aqueous layer that was formed during filtration. The aqueous layer was discarded and the organic phase was transferred back to the vessel. The temperature was adjusted to 15° C. and the solution stirred at 150 rpm for 1 hour. The product slowly precipitated from the solution to give a dense slurry. The temperature was further reduced to 10° C. and the slurry stirred at 150 rpm for 30 minutes. Finally the temperature was adjusted to 5° C. and the mixture stirred at 150 rpm for 30 minutes. In order to increase the mobility of the slurry 240 ml of n-heptane was added slowly in 30 mL portions (per 5 min). The slurry was drained and filtered off. The filter cake was dried in a vacuum oven (3-10 mm hg) at 25° C. for 72 h. A total of 28.7 g of esomeprazole was isolated (87% isolated yield) with a chemical purity of 99% by HPLC.

C. Achiral HPLC Analysis for Determination of Reaction % Conversion:

From the reaction vessel a sample of 20 µL is added into an Eppendorf tube and 1.98 mL of methanol are added (100 times dilution). The sample is centrifuged for 3 min, 100 µl of the clear supernatant solution is added into a HPLC vial with glass insert and submitted for HPLC analysis. Dilution is required within the linearity range if not below 1 g/L. The HPLC parameters used for determination of percent conversion are shown in Table 9.

TABLE 9

| Instrument | Agilent HPLC 1200 series |
|---|---|
| Column | Waters Sunfire C18 150 × 4.6 mm (5 µm), attached Waters C18 guard column |
| Mobile phase (premixed) | 53% acetonitrile, 47% water |
| Flow rate | 1.50 mL/min |
| Detection wavelength | 250 nm |
| Column temperature | 30° C. |
| Injection volume | 10 µL |
| Runtime | 4.0 min |
| Response factor (substrate area/product area) | 1.11 (at linear range 0-62.5 mg/L) |
| Retention Times | Pyrmetazole: 3.27 min |
|  | Sulfone-byproduct of compound (3): 2.32 min |
|  | (R)- or (S)-omeprazole product: 1.99 min |

D. Chiral HPLC for Determination of Chiral Analysis:

A sample of 20 µL is taken from the reaction and is evaporated to almost dryness in order to remove acetone (residual acetone is detrimental to chiral column stationary phase). The residue is dissolved in 1 mL acetonitrile (HPLC grade) and subjected to centrifugation. 100 μL of the clear supernatant solution are sampled into an HPLC vial. The solution is diluted with 900 μL of acetonitrile and submitted for HPLC analysis. The amount of diluent should be adjusted so that the Esomeprazole peak height maximum is maintained below 800 mAU. The chiral HPLC parameters used for determination of chiral purity are shown in Table 10.

TABLE 10

| Instrument | Agilent HPLC 1200 series |
|---|---|
| Column | Chiralpak AS-RH 150 × 4.6 mm (5 μm), with AS-RH guard column |
| Mobile phase (premixed) | 35% acetonitrile, 65% water |
| Flow rate | 0.6 mL/min |
| Detection wavelength | 250 nm |
| Column temperature | 35° C. |
| Injection volume | 10 μL |
| Runtime | 30 min |
| Retention Times | (R)-omeprazole: 7.45 min |
|  | (S)-omeprazole: 7.99 min |

Enantioselectivity in terms of % ee was calculated based on chiral HPLC peak areas as follows:

$$\% \ ee = \frac{(\text{Peak Area of }(S)\text{-omeprazole} - \text{Peak Area of }(R)\text{-omeprazole})}{[(\text{Peak Area of }(S)\text{-omeprazole}) + \text{Peak Area }(R)\text{-omeprazole})]} \times 100$$

Example 7

Preparation of Other Prazole Compounds Using Engineered CHMO Polypeptides

This example illustrates the use of exemplary engineered CHMO polypeptides disclosed in Tables 2A and 2B for the conversion of sulfide substrate that are structurally similar to pyrmetazole to their corresponding (R)- and/or (S)-prazole compounds that are structural analogs to (R)- and (S)-omeprazole. In this example, engineered CHMO polypeptides are screened for activity and identified that are useful for the preparation of the prazole compounds (S)-pantoprazole, (S)-tenatoprazole, (S)-rabeprazole, and (R)- and (S)-lansoprazole, as shown in Schemes 4, 5, 6, and 7 below.

A. Preparation of S-Pantoprazole

This example illustrates the use of engineered CHMO polypeptides of the present disclosure for carrying out the biocatalytic conversion of the sulfide precursor substrate (and pyrmetazole analog), 5-(difluoromethoxy)-2-((3,4-dimethoxypyridin-2-yl)methylthio)-1H-benzo[d]imidazole, to the prazole product compound (S)-pantoprazole in enantiomeric excess, as shown in Scheme 4.

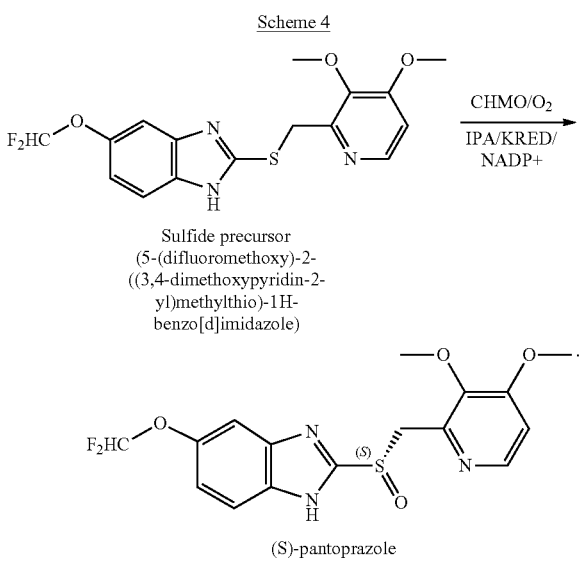

Scheme 4

Sulfide precursor (5-(difluoromethoxy)-2-((3,4-dimethoxypyridin-2-yl)methylthio)-1H-benzo[d]imidazole)

(S)-pantoprazole

Preparation of Cell-Lysate:

A cell-lysis stock solution (1 mg/mL lysozyme, 0.5 mg/mL PMBS, 100 mM phosphate buffer, pH 10) was added 600 μL per well to the wells of a deep-well plate each containing a cell pellet from E. coli expressing the engineered CHMO of interest. The plate was shaken vigorously with high speed for 1-5 min to disperse the cell pellet then followed by 1.5-2 hours of slow shaking at room temperature. The plate was then centrifuged at 4000 rpm for 20 minutes at 4° C.

Reaction:

10 μL of the pantoprazole-precursor sulfide substrate compound (5-(difluoromethoxy)-2-((3,4-dimethoxypyridin-2-yl)methylthio)-1H-benzo[d]imidazole) stock solution (1.4 g/L in IPA) was added to each well of a deep-well plate. Then 180 μL of a recycling system stock solution (0.2 g/L NADP+ cofactor and 1 g/L KRED in 100 mM phosphate, pH 10) was also added to each well of a deep well plate. The reaction was initiated by adding 10 μL of the cell-lysate solution to each well of the deep-well plate. The plate was sealed at 180° C. for 3.0 s, and then shaken at slow speed and room temperature for 2 h.

Analysis:

400 μL of acetonitrile was added to each well to quench the reaction. The plate was sealed again at 180° C. for 2.0 s, then shaken for 15-20 min at room temperature, and centrifuged at 4000 rpm for 20 min (25° C.). 200 μL of the supernatant of quenched solution was transferred to the shallow well round bottom plate and this plate was sealed at 180° C. for 3 s and then shaken for 10 min. These samples in the round bottom plate were used immediately of achiral and/or chiral HPLC analysis according to the parameters and conditions shown in Tables 11 and 12 below. The samples were stored at −4° C. if the plate was not analyzed immediately using HPLC.

TABLE 11

| Achiral HPLC parameters and conditions | |
|---|---|
| Column | Gemini-NX 5u C18, 5 μm, 50 mm × 4.6 mm |
| Solvent program | 1.5 ml/min, room temperature Isocratic at 50% ACN/50% H2O (10 mM ammonium formate) 1.3 min |
| Injection volume | 10 μL |
| Detector | UV-254 nm |

TABLE 12

| Chiral HPLC parameters and conditions | |
| --- | --- |
| Column | Chiralpak IA, 5 μm, 150 mm × 4.6 mm |
| Solvent program | 1.0 ml/min, 30° C. |
| | Isocratic at 40% ACN/60% H2O |
| | 7.0 min |
| Injection volume | 10 μL |
| Detector | UV-254 nm |

Results:

As shown below in Table 13, the following engineered CHMO polypeptides were capable of converting the precursor sulfide substrate to between about 20 and 99 percent of the (S)-pantoprazole product in enantiomeric excess: 70, 72, 76, 78, 80, 82, 84, 86, 90, 92, 94, 96, 98, 100, 102, 104, 106, 108, 110, 112, 114, 116, 118, 120, 122, 126, 128, 130, 228, 232, 244, 248, 256, 258, 260, 262, and 264. This represents between about 60-fold and 310-fold improvement in percent conversion of this substrate to this product relative to the wild-type CHMO of SEQ ID NO: 2. The engineered CHMO polypeptides of SEQ ID NO: 236 and 240 were capable of converting the precursor sulfide substrate to 20% and 27% to the opposite enantiomer, (R)-pantoprazole, in high enantiomeric excesses of 86 and 89%, respectively.

TABLE 13

| SEQ ID NO: | % Conversion | % Conversion FIOP (relative to SEQ ID NO: 2) | % ee of S-isomer |
| --- | --- | --- | --- |
| 69/70 | 30.3 | 95 | 34.2 |
| 71/72 | 33.2 | 105 | 29.7 |
| 75/76 | 68.1 | 215 | 18.7 |
| 77/78 | 51.1 | 161 | 41.9 |
| 79/80 | 39.5 | 124 | 28.1 |
| 81/82 | 38.5 | 121 | 27.3 |
| 83/84 | 50.6 | 160 | 49.9 |
| 85/86 | 96.8 | 306 | 87.6 |
| 89/90 | 71.8 | 227 | 82.1 |
| 91/92 | 68.7 | 217 | 39.8 |
| 93/94 | 59.4 | 187 | 88.1 |
| 95/96 | 97.8 | 309 | 81.3 |
| 97/98 | 99.2 | 313 | 90.8 |
| 99/100 | 89.9 | 284 | 80.7 |
| 101/102 | 98.4 | 310 | 82.1 |
| 103/104 | 99.3 | 313 | 92 |
| 105/106 | 33.9 | 107 | 95.6 |
| 107/108 | 98.2 | 310 | 95.2 |
| 109/110 | 97.5 | 307 | 95.3 |
| 111/112 | 99.0 | 312 | 95.2 |
| 113/114 | 74.8 | 236 | 85.3 |
| 115/116 | 97.5 | 308 | 98.5 |
| 117/118 | 94.0 | 297 | 100 |
| 119/120 | 99.1 | 313 | 98.9 |
| 121/122 | 90.8 | 286 | 99.1 |
| 125/126 | 98.2 | 310 | 97.4 |
| 127/128 | 97.8 | 308 | 98.7 |
| 129/130 | 98.9 | 312 | 98.7 |
| 227/228 | 22.5 | 71 | 97.7 |
| 231/232 | 26.7 | 84 | 85.8 |
| 235/236 | 20.1 | 63 | −88.8 |
| 239/240 | 27.1 | 85 | −86.9 |
| 243/244 | 41.9 | 132 | 100 |
| 247/248 | 22.1 | 70 | 89.9 |
| 255/256 | 20.6 | 65 | 95.8 |
| 257/258 | 28.4 | 89 | 96.6 |
| 259/260 | 68.2 | 215 | 92.7 |
| 261/262 | 46.0 | 145 | 87.5 |
| 263/264 | 49.3 | 155 | 91.3 |

B. Preparation of S-Tenatoprazole

This example illustrates the use of engineered CHMO polypeptides of the present disclosure for carrying out the biocatalytic conversion of the sulfide precursor substrate (and pyrmetazole analog), 5-methoxy-2-((4-methoxy-3,5-dimethylpyridin-2-yl)methylthio)-1H-imidazo[4,5-b]pyridine, to the prazole product compound (S)-tenatoprazole in enantiomeric excess, as shown in Scheme 5.

Scheme 5

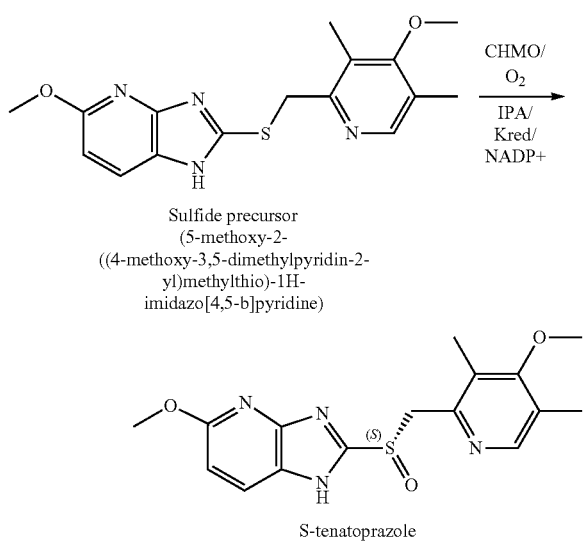

Sulfide precursor
(5-methoxy-2-
((4-methoxy-3,5-dimethylpyridin-2-
yl)methylthio)-1H-
imidazo[4,5-b]pyridine)

S-tenatoprazole

Preparation of Cell-Lysate:

A cell-lysis stock solution (1 mg/mL lysozyme, 0.5 mg/mL PMBS, 100 mM phosphate buffer, pH 10) was added 600 μL per well to the wells of a deep-well plate each containing a cell pellet from E. coli expressing a CHMO of interest. The plate was shaken vigorously with high speed for 1-5 min to disperse the cell pellet then followed by 1.5-2 hours of slow shaking at room temperature. The plate was then centrifuged at 4000 rpm for 20 minutes at 4° C.

Reaction:

10 μL of the tenatoprazole-precursor sulfide substrate compound (5-methoxy-2-((4-methoxy-3,5-dimethylpyridin-2-yl)methylthio)-1H-imidazo[4,5-b]pyridine) stock solution (0.65 g/L in IPA) was added to each well of a deep-well plate. Then 180 μL of a recycling system stock solution (0.2 g/L NADP+ cofactor and 1 g/L KRED in 100 mM phosphate, pH 10) was also added to each well of a deep well plate. The reaction was initiated by adding 10 μL of the cell-lysate solution to each well of the deep-well plate. The plate was sealed at 180° C. for 3.0 s, and then shaken at slow speed and room temperature for 2 h.

Analysis:

400 μL of acetonitrile was added to each well to quench the reaction. The plate was sealed again at 180° C. for 2.0 s, then shaken for 15-20 min at room temperature, and centrifuged at 4000 rpm for 20 min (25° C.). For achiral HPLC sample preparation, 200 μL of the supernatant of quenched solution was transferred to the shallow-well round bottom plate and this plate was sealed at 180° C. for 3 s and then shaken for 10 min. These samples in the round bottom plate were used immediately for achiral HPLC analysis according to the parameters and conditions shown in Table 14 below. The samples were stored at −4° C. if the plate was not analyzed immediately using HPLC.

TABLE 14

Achiral HPLC parameters and conditions (for determining % conversion)

| | |
|---|---|
| Column | Gemini-NX 5u C18, 5 μm, 50 mm × 4.6 mm |
| Solvent program | 1.5 ml/min, 30° C. |
| | Isocratic at 50% ACN/50% H2O (10 mM ammonium formate) 1.5 min |
| Injection volume | 10 μL |
| Detector | UV-254 nm |

For chiral HPLC sample preparation, the 200 μL of the supernatant of quenched solution in the shallow-well round bottom plates was fully evaporated in a vacuum oven and 200 μL of MTBE was added to each well. The plate was sealed at 180° C. for 2 sec and shaken for 10 min then used immediately for chiral HPLC analysis according to the parameters and conditions shown in Table 15 below. The samples were stored at −4° C. if the plate was not analyzed immediately using HPLC.

TABLE 15

Chiral HPLC parameters and conditions

| | |
|---|---|
| Column | Chiralpak AS-H, 5 μm, 250 mm × 4.6 mm |
| Solvent program | 0.6 ml/min, 20° C. |
| | Isocratic at 20% hexane/80% ethanol 11.0 min |
| Injection volume | 5 μL |
| Detector | UV-254 nm |

Results:

As shown below in Table 16, the following engineered CHMO polypeptides were capable of converting the precursor sulfide substrate to between about 10 and 60 percent of the (S)-tenatoprazole product in 100% ee: 66, 102, 104, 114, 122, 124, 128, 232, 238, 244, 260, 262, and 264. This represents between about 10-fold and 60-fold improvement in percent conversion of this substrate to this product relative to the wild-type CHMO of SEQ ID NO: 2.

TABLE 16

| SEQ ID NO: | % Conversion | % Conversion FIOP (relative to SEQ ID NO: 2) | % ee of S-isomer |
|---|---|---|---|
| 65/66 | 13.3 | 22.9 | 100 |
| 101/102 | 21.1 | 36.3 | 100 |
| 103/104 | 25.8 | 44.4 | 100 |
| 113/114 | 16.3 | 27.9 | 100 |
| 121/122 | 17.6 | 30.2 | 100 |
| 123/124 | 6.8 | 11.7 | 100 |
| 127/128 | 9.1 | 15.6 | 100 |
| 231/232 | 33.4 | 57.3 | 100 |
| 237/238 | 11.8 | 20.3 | 100 |
| 243/244 | 30.9 | 53.0 | 100 |
| 259/260 | 35.9 | 61.7 | 100 |
| 261/262 | 30.4 | 52.1 | 100 |
| 263/264 | 29.0 | 49.9 | 100 |

C. Preparation of S-Rabeprazole

This example illustrates the use of engineered CHMO polypeptides of the present disclosure for carrying out the biocatalytic conversion of the sulfide precursor substrate (and pyrmetazole analog), 2-((4-(3-methoxypropoxy)-3-methylpyridin-2-yl)methylthio)-1H-benzo[d]imidazole, to the prazole compound (S)-rabeprazole in enantiomeric excess, as shown in Scheme 6.

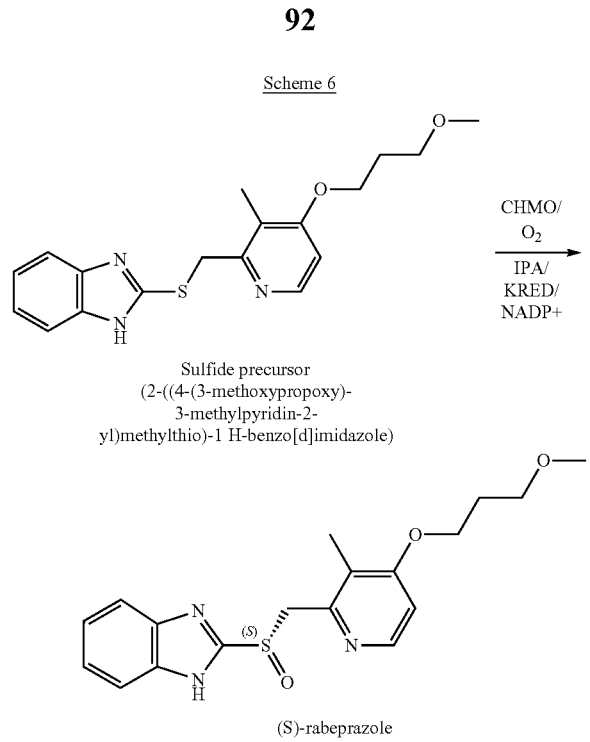

Scheme 6

Sulfide precursor
(2-((4-(3-methoxypropoxy)-3-methylpyridin-2-yl)methylthio)-1 H-benzo[d]imidazole)

(S)-rabeprazole

Preparation of Cell-Lysate:

A cell-lysis stock solution (1 mg/mL lysozyme, 0.5 mg/mL PMBS, 100 mM phosphate buffer, pH 10) was added 600 μL per well to the wells of a deep-well plate each containing a cell pellet from *E. coli* expressing the engineered CHMO of interest. The plate was shaken vigorously with high speed for 1-5 min to disperse the cell pellet then followed by 1.5-2 hours of slow shaking at room temperature. The plate was then centrifuged at 4000 rpm for 20 minutes at 4° C.

Reaction:

10 μL of the rabeprazole-precursor sulfide substrate compound (2-((4-(3-methoxypropoxy)-3-methylpyridin-2-yl) methylthio)-1H-benzo[d]imidazole) stock solution (1.9 g/L in IPA) was added to each well of a deep-well plate. Then 180 μL of a recycling system stock solution (0.2 g/L NADP+ cofactor and 1 g/L KRED in 100 mM phosphate, pH 10) was also added to each well of a deep well plate. The reaction was initiated by adding 10 μL of the cell-lysate solution to each well of the deep-well plate. The plate was sealed at 180° C. for 3.0 s, and then shaken at slow speed and room temperature for 2 h.

Analysis:

400 μL of acetonitrile was added to each well to quench the reaction. The plate was sealed again at 180° C. for 2.0 s, then shaken for 15-20 min at room temperature, and centrifuged at 4000 rpm for 20 min (25° C.). For achiral HPLC sample preparation, 200 μL of the supernatant of quenched solution was transferred to the shallow-well round bottom plate and this plate was sealed at 180° C. for 3 s and then shaken for 10 min. These samples in the round bottom plate were used immediately for achiral HPLC analysis according to the parameters and conditions shown in Table 17 below. The samples were stored at −4° C. if the plate was not analyzed immediately using HPLC.

TABLE 17

| Achiral HPLC parameters and conditions | |
|---|---|
| Column | Gemini-NX 5u C18, 5 µm, 50 mm × 4.6 mm |
| Solvent program | 1.5 mL/min, 30° C. |
| | Isocratic at 50% ACN/50% H$_2$O (10 mM ammonium formate) 1.5 min |
| Injection volume | 10 µL |
| Detector | UV-254 nm |

For chiral HPLC sample preparation, the 200 µL of the supernatant of quenched solution in the shallow-well round bottom plates was fully evaporated in a vacuum oven and 200 µL of MTBE was added to each well. The plate was sealed at 180° C. for 2 sec and shaken for 10 min then used immediately for chiral HPLC analysis according to the parameters and conditions shown in Table 18 below. The samples were stored at −4° C. if the plate was not analyzed immediately using HPLC.

TABLE 18

| Chiral HPLC parameters and conditions | |
|---|---|
| Column | Chiralpak AD-H, 5 µm, 250 mm × 4.6 mm |
| Solvent program | 1.0 mL/min, 30° C. |
| | Isocratic at 65% hexane/20% ethanol/15% isopropyl alcohol 10.0 min |
| Injection volume | 5 µL |
| Detector | UV-254 nm |

Results:

Use of the wild-type CHMO of SEQ ID NO: 2 did not result in any detectable conversion of 2-((4-(3-methoxypropoxy)-3-methylpyridin-2-yl)methylthio)-1H-benzo[d]imidazole to (R)- or (S)-rabeprazole. As shown below in Table 19, the following engineered CRMO polypeptides were capable of converting the precursor sulfide substrate to between about 1 and 10 percent of the (S)-rabeprazole product: 62, 76, 84, 86, 124, 238, 240, 250, 258, 262, and 264. Chiral HPLC analysis of the two polypeptides with the highest % conversion, SEQ ID NO: 76 and 86, showed that they produced the (S)-rabeprazole product in 100% ee.

TABLE 19

| SEQ ID NO: | % Conversion | % ee of S-isomer |
|---|---|---|
| 61/62 | 1.56 | |
| 75/76 | 3.25 | 100 |
| 83/84 | 2.19 | |
| 85/86 | 10.27 | 100 |
| 123/124 | 1.49 | |
| 237/238 | 1.89 | |
| 239/240 | 1.20 | |
| 249/250 | 1.81 | |
| 257/258 | 3.06 | |
| 261/262 | 3.06 | |
| 263/264 | 2.43 | |

D. Preparation of S-Lansoprazole or R-Lansoprazole ("Dexlansoprazole")

This example illustrates the use of engineered CHMO polypeptides of the present disclosure for carrying out the biocatalytic conversion of the sulfide precursor substrate (and pyrmetazole analog), 2-((3-methyl-4-(2,2,2-trifluoroethoxy)pyridin-2-yl)methylthio)-1H-benzo[d]imidazole, to either of the prazole compounds (S)-lansoprazole or (R)-lansoprazole in enantiomeric excess, as shown in Scheme 7.

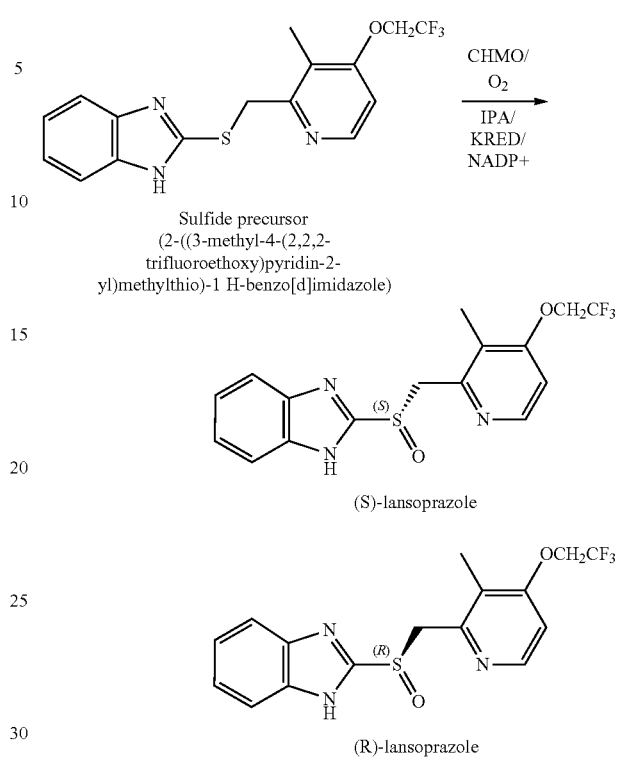

Scheme 7

Sulfide precursor (2-((3-methyl-4-(2,2,2-trifluoroethoxy)pyridin-2-yl)methylthio)-1 H-benzo[d]imidazole)

(S)-lansoprazole (R)-lansoprazole

Screening assays using the sulfide precursor substrate 2-((3-methyl-4-(2,2,2-trifluoroethoxy)pyridin-2-yl)methylthio)-1H-benzo[d]imidazole were carried out with certain engineered CHMO polypeptides of the present disclosure. Assay conditions and results for % conversion and product enantioselectivity are provided below in Table 20.

TABLE 20

| SEQ ID NO: | % Conversion | Enantioselectivity (% ee) |
|---|---|---|
| 5/6 | 1.2[1] | R-selective (n.d.)[4] |
| 21/22 | 1.1[2] | S-selective (n.d.)[4] |
| 71/72 | 27[3] | S-selective (71.7% ee) |
| 79/80 | 19[3] | S-selective (91.6% ee) |

[1]1.5 g/L lansoprazole sulfide, 15 g/L enzyme, 0.5 g/L NADP$^+$, 1 g/L KRED, 4% IPA, 25 mM phosphate buffer pH 8.5, 17 h reaction time.
[2]2.0 g/L lansoprazole sulfide, 25 g/L enzyme, 0.5 g/L NADP$^+$, 1 g/L KRED, 4% IPA, 25 mM phosphate buffer pH 8.5, 17 h reaction time.
[3]1.5 g/L lansoprazole sulfide, 5 g/L enzyme, 0.5 g/L NADP+, 1 g/L KRED, 4% IPA, 25 mM phosphate buffer pH 8.5, 24 h reaction time.
[4]% ee could not be determined due to low % conversion of substrate to product.

As shown in Table 20, the engineered CHMO polypeptides of SEQ ID NO: 22, 72, and 80, are capable of converting the lansoprazole sulfide precursor substrate to (S)-lansoprazole in enantiomeric excess. The polypeptides of SEQ ID NO: 72 and 80 are capable of 27% and 19% conversion with enantioselectivity of about 72% ee and 92% ee, respectively. Although the engineered CHMO polypeptide of SEQ ID NO: 6 showed only 1% conversion it was confirmed to be selective for the (R)-lansoprazole product. The polypeptide of SEQ ID NO: 6 was also found to convert pyrmetazole to favor the (R)-omeprazole product over the (S)-omeprazole product in 98.9% enantiomeric excess (see Table 2A). It is reasonable to expect that further directed evolution of the engineered polypeptide of SEQ ID NO: 6 will result in an engineered CHMO polypeptide capable of producing the (R)-lansoprazole product in high enantiomeric excess (e.g., 98% or greater) and much higher % conversion (e.g., 20% or greater).

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (268 sequences)

SEQ ID NO: 1 - DNA, 1632 bp, Artificial Sequence
  Codon-optimized cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccattcaccaacctgccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagctggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 2 - protein, 543 aa, Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPFTNLPPSIESQVEWISDTIQYTVENNVESIEATKEAEEQWTQTCANIAEMTLFPKAQSWIFGANIPGKKNTVYFYLGGLKEYRSALANCKNHAYEGFDIQLQRSDIKQPANA

SEQ ID NO: 3 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 4 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 5 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggtttccgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaacccgccctaattgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcgatagacggcaactatgttcgcatggatatccaagggaaaaacggtctggccatgaaggattactggaaagagggcccgtctagctacatgggcgtaaccgtgaataattacccaaacatgtttatggttctgggtccaaacggtccatcaggtaacgcaccgcctagcattgaaagtcaagttgaatggattagcgatactatccggtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 6 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYATRPNCDSGYYNTFNRDNVRLEDVKANPIVEITENGVKLENGDFVELDMLICATGFDAIDGNYVRMDIQGKNGLAMKDYWKEGPSSYMGVTVNNYPNMFMVLGPNGPSGNAPPSIESQVEWISDTIRYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 7 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 8 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 9 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 10 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPAANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 11 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 12 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 13 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctatcattgaaagtcaagttgaatggattagctggactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 14 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPAANSPPIIESQVEWISWTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 15 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 16 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 17 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtgcacagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacatcaaacaaccagcgaatgcgtaa

SEQ ID NO: 18 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDIKQPANA

SEQ ID NO: 19 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctaccaaatatcaagggcatcaatcagtttaaaggcgcactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacaccaaacaaccagcgaatgcgtaa

SEQ ID NO: 20 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGALHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDTKQPANA

SEQ ID NO: 21 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaacgttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgcactgcaccatacttcccgctggccggatgacgtgagtcttgaaggcaaacgtgtgggtgtgatcggcacaggctctaccggcgtgcaagttatcacggcagtggcgccactggccaagcacctgacggtgtttcagcgtagtgcacagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctacaacgttctgacatcaaacaaccagcgaatgcgtaa

SEQ ID NO: 22 - protein, 543 aa, Artificial Sequence
  Variant of cyclohexanone monooxygenase from Acinetobacter sp NCIMB9871
MSTKMDFDAIVIGGGFGGLYAVKKLRDELELNVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGALHHTSRWPDDVSLEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 23 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcaggggcgccactggccaagcacctgacggtgtttcagcgtagtgcacagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 24 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAGAPLAKHLTVFQRSAQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 25 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggacgtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctaacggtgtttcagcgtagtgcacagtactcggtcccgatcggtaacgatccactgagcgaagaagacgtcaagaagatcaaagataactatgataaaatctgggatggtgttaaaaacagtgcggtggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcagggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacatcaaacaaccagcgaatgcgtaa

SEQ ID NO: 26 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWDVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVKNSAVAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRRDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDIKQPANA

SEQ ID NO: 27 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgtaaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtgcacagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 28 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 29 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggagcgtctagctacatgggcgtaaccgtgaataattacccaaacatgtttatggttctgggtttaaacggtccactggttaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagccccaacgttctgacatcaaacaagcagcgaatgcgtaa

SEQ ID NO: 30 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVKNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGASSYMGVTVNNYPNMFMVLGLNGPLVNSPPIIESQVEWISVTIQYTVENNVESIEATKEAEEQWTQTCANIAEMTLFPKAQSRIFGANIPGKKNTVYFYLGGLKEYRSVLANCKNHAYEGFDIQPQRSDIKQAANA

SEQ ID NO: 31 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 32 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 33 - DNA, 1632 bp, Artificial Sequence
  Variant of cyclohexanone monooxygenase from Acinetobacter sp NCIMB9871
atgtctaccaagatggatttcgatgccatcgtgatcggtggggcttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccataggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactgccaaagaacctgacggtgtttcagcgtagtgcacagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtattataatacgttcaatcgcgacaacgtacgtctggaggatgtcaaagcaaatccgatcgtcgagatcaccgaaaacggcgtgaaactggaaaacggcgaaaacgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 34 - protein, 543 aa, Artificial Sequence
  Variant of cyclohexanone monooxygenase from Acinetobacter sp NCIMB9871
MSTKMDFDAIVIGGAFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAIGLLSAPNLPNIKGINQFKGELHHTSRWPDDVSFEGKRVGVIGTGSTGVQVITAVAPLPKNLTVFQRSAQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGENVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 35 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 36 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 37 - DNA, 1632 bp, Artificial Sequence; identical to SEQ ID NO: 35
  Variant of cyclohexanone monooxygenase from Acinetobacter sp NCIMB9871

SEQ ID NO: 38 - protein, 543 aa, Artificial Sequence; identical to SEQ ID NO: 36
  Variant of cyclohexanone monooxygenase from Acinetobacter sp NCIMB9871

SEQ ID NO: 39 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctacccctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtactggtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 40 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSTPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYWYLGGLKEYRSVLANCKNHAYEGFDIQLQRSDTKQPANA

SEQ ID NO: 41 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaaaaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 42 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFKTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 43 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgcagctaaaaaactgcgcgatgaactggagctgaaagttaaagccttcgacaaggcaactgacgtagcggaaacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgtgctgcaccatacttcccgctggccggatgacgtgagttttgaagataaacgtgtgggtgtgatcggcacaggctctaccggcgtgcaagttatcacgtcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggtctgcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtcagactccgggtactataatacgttcaatcgcgacaacgtacgtctggaggatgtcaaagcaaatccgatcgcggagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 44 - protein, 543 aa, Artificial Sequence
  Variant of cyclohexanone monooxygenase from Acinetobacter sp NCIMB9871
MSTKMDFDAIVIGGGFGGLYAAKKLRDELELKVKAFDKATDVAETWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGVLHHTSRWPDDVSFEDKRVGVIGTGSTGVQVITSVAPLAKHLTVFQRSPQYSVPIGNDPLSEEDVKKIKDNYDKIWDGVKNSALAFGLNESTVPAMSVSAEERKAVFEKAWQTGGGLRFMFETFGDIITNMEANIEAQNFIKGKIAEIVKDPAIAQKLMPQDLYACRPLSDSGYYNTFNRDNVRLEDVKANPIAEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 45 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctacccctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgcggagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 46 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSTPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIAEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 47 - DNA, 1632 bp, Artificial Sequence; identical to SEQ ID NO: 31
  Variant of cyclohexanone monooxygenase from Acinetobacter sp NCIMB9871

SEQ ID NO: 48 - protein, 543 aa, Artificial Sequence; identical to SEQ ID NO: 32
  Variant of cyclohexanone monooxygenase from Acinetobacter sp NCIMB9871

SEQ ID NO: 49 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaggccttcgacaaggcaactgacgtagcgggtacatggtactggaaccgctacccgggtgcactgaccgataccgaaacccatttgtattgttattcctgggacaaggaactgttgcagggtttggaaatcaaaaagaaatacgtgcaaggtccagacgtgcgcaaatatctgaaccaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgtacctaacgtgccaaatatcaagggcatcaatcagtttaaaggcgatctgcaccatacttcccgctggccggatgacgtgagtttagaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagccgcaacgttctgacacaaaacaaccagcgaatgcgtaa

SEQ ID NO: 50 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQGLEIKKKYVQGPDVRKYLNQVAEKHDLKKSYQFNTAVQSAHYNEADALWEVTTEYGDKYTARFLITALGLLSVPNVPNIKGINQFKGDLHHTSRWPDDVSLEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQPQRSDTKQPANA

SEQ ID NO: 51 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagtgcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 52 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQCRIFGANIPGKKNTVYFYLGGLKEYRSVLANCKNHAYEGFDIQLQRSDTKQPANA

SEQ ID NO: 53 - DNA, 1632 bp, Artificial Sequence
  Variant of cyclohexanone monooxygenase from Acinetobacter sp NCIMB9871
atgtctaccaagatggatttcgatgccatcgtgatcggtgccggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgttcctaacctgccaaatatcaagggcatcaatcagtttaaaggcgaactgcaccatacttcccgctggccggatgacgtgagtctggaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagtgcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 54 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSVPNLPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQCRIFGANIPGKKNTVYFYLGGLKEYRSVLANCKNHAYEGFDIQLQRSDTKQPANA

SEQ ID NO: 55 - DNA, 1632 bp, Artificial Sequence
  Variant of cyclohexanone monooxygenase from Acinetobacter sp NCIMB9871
atgtctaccaagatggatttcgatgccatcgtgatcggtgccggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtcggtttgctgtctgtgcctaacctgccaaatatcaagggcatcaatcagtttaaaggcgaactgcaccatacttcccgctggccggatgacgtgagtctggaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggtttcggcctgaatgaatctactgtgccggccatgtccgtaagtgcggaagagcgtaaagcggtttttgagaaggcgtggcaaaccggcggtggtttacgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgggtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 56 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSVPNLPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALGFGLNESTVPAMSVSAEERKAVFEKAWQTGGGLRFMFETFGDIITNMEANIEAQNFIKGKIAEIVKDPAIAQKLMPQDLYACRPLGDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 57 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagtgcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 58 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVTIQYTVENNVESIEATKEAEEQWTQTCANIAEMTLFPKAQCRIFGANIPGKKNTVYFYLGGLKEYRSVLANCKNHAYEGFDIQLQRSDTKQPANA

SEQ ID NO: 59 - DNA, 1632 bp, Artificial Sequence; identical to SEQ ID NO: 57
  Variant of cyclohexanone monooxygenase from Acinetobacter sp NCIMB9871

SEQ ID NO: 60 - protein, 543 aa, Artificial Sequence; identical to SEQ ID NO: 58
  Variant of cyclohexanone monooxygenase from Acinetobacter sp NCIMB9871

SEQ ID NO: 61 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgacggataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagtgcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 62 - protein, 543 aa, Artificial Sequence; identical to SEQ ID NO: 58
  Variant of cyclohexanone monooxygenase from Acinetobacter sp NCIMB9871

SEQ ID NO: 63 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaggccacgaaggaagcggaggaacagtggacccaaacctgcgccaatattgcggagatgaccctgtttccaaaagcccagtgcaggatttttggggcgaacattccgggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 64 - protein, 543 aa, Artificial Sequence; identical to SEQ ID NO: 58
  Variant of cyclohexanone monooxygenase from Acinetobacter sp NCIMB9871

SEQ ID NO: 65 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagtttagaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgcatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaagaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 66 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 67 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtggaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagtttagaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgcatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaagaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 68 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVEGPDVRKYLQQVAEKHDLKKSYQFNTAVQSAHYNEADALWEVTTEYGDKYTARFLITAVGLLSAPNLPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 69 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 70 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 71 - DNA, 1632 bp, Artificial Sequence; identical to SEQ ID NO: 69
  Variant of cyclohexanone monooxygenase from Acinetobacter sp NCIMB9871

SEQ ID NO: 72 - protein, 543 aa, Artificial Sequence; identical to SEQ ID NO: 70
  Variant of cyclohexanone monooxygenase from Acinetobacter sp NCIMB9871

SEQ ID NO: 73 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacgcaaaccgcggccaacattgcggagatgaccctgtttccaaaagcccagtgcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 74 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVTIQYTVENNVESIEATKEAEEQWTQTAANIAEMTLFPKAQCRIFGANIPGKKNTVYFYLGGLKEYRSVLANCKNHAYEGFDIQLQRSDTKQPANA

SEQ ID NO: 75 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 76 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 77 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggcggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 78 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 79 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggcggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccgctacaacgaagcggacgctctgtgggaagtaactacggaatacggggataagtacaccgcacgtttcctgattactgccgtgggtttgctgtctgcacctaacctgccaaatatcaagggcatgaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttatgatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 80 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKELLQSLEIKKKYVQGPDVRKYLQQVAEKHDLKKSYQFNTAVQSARYNEADALWEVTTEYGDKYTARFLITAVGLLSAPNLPNIKGMNQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVMIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 81 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggcggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccgctacaacgaagcggacgctctgtgggaagtaactacggaatacggggataagtacaccgcacgtttcctgattactgccgtgggtttgctgtctgcacctaacctgccaaatatcaagggcatgaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttatgatccagtataccgtcgaaaataatgtgaaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 82 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKELLQSLEIKKKYVQGPDVRKYLQQVAEKHDLKKSYQFNTAVQSARYNEADALWEVTTEYGDKYTARFLITAVGLLSAPNLPNIKGMNQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVMIQYTVENNVKSIEATKEAEEQWTQTCANIAEKTLFPKAQCRIFGANIPGKKNTVYLYLGGLKEYRSVLANCKNHAYEGFDIQLQRSDTKQPANA

SEQ ID NO: 83 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggcggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatgtcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 84 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDVVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 85 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 86 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 87 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctggggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 88 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAWGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 89 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 90 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 91 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccatcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 92 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVFIQYTIENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 93 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggctgtaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 94 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGCNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 95 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcaataatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 96 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGNNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 97 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 98 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 99 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcagtaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 100 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGSNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 101 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtattttggtgggctgaaagagtaccgctcagttttggcgaattgtaaaaatcatgcgtatgaaggctttgatattcagctgcaacgttctgacacaaaacaaccagcgaatgcgtaa

SEQ ID NO: 102 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYFGGLKEYRSVLANCKNHAYEGFDIQLQRSDTKQPANA

SEQ ID NO: 103 - DNA, 1632 bp, Artificial Sequence; identical to SEQ ID NO: 1
  Variant of cyclohexanone monooxygenase from Acinetobacter sp NCIMB9871

SEQ ID NO: 104 - protein, 543 aa, Artificial Sequence; identical to SEQ ID NO: 2
  Variant of cyclohexanone monooxygenase from Acinetobacter sp NCIMB9871

SEQ ID NO: 105 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgtcggctttgatattcagctgcaacgttctgacacaaaacaacaggcgaatgcgtaa

SEQ ID NO: 106 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYVGFDIQLQRSDTKQQANA

SEQ ID NO: 107 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccccaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcttgaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 108 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTPTHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGLKNTVYLYLGGLKEYRSVLANCKNHAYEGFDIQLQRSDTKQPANA

SEQ ID NO: 109 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcttgaagaacaccgtgtacctgtatttgggtgggctgaaagagtaccgctcagttttggcgaattgtaaaaatcatgcgtatgtcggctttgatattcagctgcaacgttctgacacaaaacaacaggcgaatgcgtaa

SEQ ID NO: 110 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGLKNTVYLYLGGLKEYRSVLANCKNHAYVGFDIQLQRSDTKQQANA

SEQ ID NO: 111 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccacagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaacaggcgaatgcgtaa

SEQ ID NO: 112 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQQANA

SEQ ID NO: 113 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaacaggcgaatgcgtaa

SEQ ID NO: 114 - protein, 543 aa, Artificial Sequence; identical to SEQ ID NO: 112
  Variant of cyclohexanone monooxygenase from Acinetobacter sp NCIMB9871

SEQ ID NO: 115 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcagtaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttttgatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 116 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGSNESTVPAMSVSAEERKAVFEKAWQTGGGFRFMFETFGDIITNMEANIEAQNFIKGKIARIVKDPAIAQKLMPQDLYACRPLCDSGYYNTFNRENVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVLIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 117 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtctggaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatcaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcttgaagaacaccgtgtacctgtatttgggtgggctgaaagagtaccgctcagttttggcgaattgtaaaaatcatgcgtatgtcggctttgatattcagctgcaacgttctgacacaaaacaacaggcgaatgcgtaa

SEQ ID NO: 118 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAIKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGLKNTVYLYLGGLKEYRSVLANCKNHAYVGFDIQLQRSDTKQQANA

SEQ ID NO: 119 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtctggaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcattgatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcttgaagaacaccgtgtacctgtatttgggtgggctgaaagagtaccgctcagttttggcgaattgtaaaaatcatgcgtatgtcggctttgatattcagctgcaacgttctgacacaaaacaacaggcgaatgcgtaa

SEQ ID NO: 120 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRIDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGLKNTVYLYLGGLKEYRSVLANCKNHAYVGFDIQLQRSDTKQQANA

SEQ ID NO: 121 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtctggaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcattgatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcttgaagaacaccgtgtacctgtatttgggtgggctgaaagagtaccgctcagttttggcgaattgtaaaaatcatgcgtatgtcggctttgatattcagctgcaacgttctgacacaaaacaacaggcgaatgcgtaa

SEQ ID NO: 122 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRIDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGLKNTVYLYLGGLKEYRSVLANCKNHAYVGFDIQLQRSDTKQQANA

SEQ ID NO: 123 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccacgaaggaagcggaggaacagtggacccaaacctgcgccaatattgcggagaaaaccctgtttccaaaagccaaatgcaggatttttggggcgaacattccaggcttgaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 124 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRENVRLEDVKANPIVEITENGVKLENGDFVELDMLICATGFDAGDGSYKRIDIQGKNGLAIKDYWKEGPSSYMGVAVNNYPNMFMVFGPNGPLANSPPIIESQVEWISVFIQYTVENNVESIEATKEAEEQWTQTCANIAEKTLFPKAKCRIFGANIPGLKNTVYLYLGGLKEYRSVLANCKNHAYVGFDIQLQRSDTKQQANA

SEQ ID NO: 125 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcatggatatccaagggaaaaacggtctggccatcaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccacgaaggaagcggaggaacagtggacccaaacctgcgccaatattgcggagaaaaccctgtttccaaaagccaaatgcaggatttttggggcgaacattccaggcttgaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 126 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAGDGSYKRMDIQGKNGLAIKDYWKEGPSSYMGVAVNNYPNMFMVFGPNGPLANSPPIIESQVEWISVFIQYTVENNVESIEATKEAEEQWTQTCANIAEKTLFPKAKCRIFGANIPGLKNTVYLYLGGLKEYRSVLANCKNHAYVGFDIQLQRSDTKQQANA

SEQ ID NO: 127 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaagggaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcatggatatccaagggaaaaacggtctggccatcaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccacgaaggaagcggaggaacagtggacccaaacctgcgccaatattgcggagaaaaccctgtttccaaaagccaaatgcaggatttttggggcgaacattccaggcttgaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 128 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKGTDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAGDGSYKRMDIQGKNGLAIKDYWKEGPSSYMGVAVNNYPNMFMVFGPNGPLANSPPIIESQVEWISVFIQYTVENNVESIEATKEAEEQWTQTCANIAEKTLFPKAKCRIFGANIPGLKNTVYLYLGGLKEYRSVLANCKNHAYVGFDIQLQRSDTKQQANA

SEQ ID NO: 129 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcattgatatccaagggaaaaacggtctggccatcaaggattactggaaagagggcccgtctagctacatgggcgtagcagtgaataattacccaaacatgtttatggttttcggtccaaacggtccactggctaactccccgcctatcattgaaagtcaagttgaatggattagcgttttaatccagtataccgtcgaaaataatgtggaatctattgaagccacgaaggaagcggaggaacagtggacccaaacctgcgccaatattgcggagaaaaccctgtttccaaaagccaaatgcaggatttttggggcgaacattccaggcttgaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 130 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAGDGSYKRIDIQGKNGLAIKDYWKEGPSSYMGVAVNNYPNMFMVFGPNGPLANSPPIIESQVEWISVLIQYTVENNVESIEATKEAEEQWTQTCANIAEKTLFPKAKCRIFGANIPGLKNTVYLYLGGLKEYRSVLANCKNHAYVGFDIQLQRSDTKQQANA

SEQ ID NO: 131 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccacgaaggaagcggaggaacagtggacccaaacctgcgccaatattgcggagaaaaccctgtttccaaaagccaaatgcaggatttttggggcgaacattccaggccggaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 132 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRENVRLEDVKANPIVEITENGVKLENGDFVELDMLICATGFDAGDGSYKRIDIQGKNGLAIKDYWKEGPSSYMGVAVNNYPNMFMVFGPNGPLANSPPIIESQVEWISVFIQYTVENNVESIEATKEAEEQWTQTCANIAEKTLFPKAKCRIFGANIPGRKNTVYLYLGGLKEYRSVLANCKNHAYVGFDIQLQRSDTKQQANA

SEQ ID NO: 133 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggggtatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccacgaaggaagcggaggaacagtggacccaaacctgcgccaatattgcggagaaaaccctgtttccaaaagccaaatgcaggatttttggggcgaacattccaggcttgaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 134 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIARIVKDPAIAQKLMPQDLYACRPLCDSGYYNTFNRENVRLEDVKANPIVEITENGVKLENGDFVELDMLICATGFDAGDGSYKRIDIQGKNGLAIKDYWKEGPSSYMGVAVNNYPNMFMVFGPNGPLANSPPIIESQVEWISVFIQYTVENNVESIEATKEAEEQWTQTCANIAEKTLFPKAKCRIFGANIPGLKNTVYLYLGGLKEYRSVLANCKNHAYVGFDIQLQRSDTKQQANA

SEQ ID NO: 135 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacgaggcaactgacgtaggtggtacatggtactggaaccgctacccgggtgcactgaccgataccgaaacccatttgtatcgctattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgcgacgggttttgatgcgggtgacggcagctataaacgcattgatatccaagggaaaaacggtctggccattaaggattactggaaagatggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcaaaaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 136 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDEATDVGGTWYWNRYPGALTDTETHLYRYSWDKEMLQSLEIKKKYVEGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIACIVKDPAIAQKLMPQDLYACRPLCDSGYYNTFNRENVRLEDVKANPIVEITENGVKLENGDFVELDLLICATGFDAGDGSYKRIDIQGKNGLAIKDYWKDGPSSYMGVAVNNYPNMFMVFGPNGPLANSPPIIESQVEWISVFIQYTVENNVESIEADKEAEEQWTQTCANIAEKTLFPKAKCRIFGANIPGKKNTVYLYLGGLKEYRSVLANCKNHAYVGFDIQLQRSDTKQQANA

SEQ ID NO: 137 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcaaaaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 138 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIACIVKDPAIAQKLMPQDLYACRPLCDSGYYNTFNRENVRLEDVKANPIVEITENGVKLENGDFVELDLLICATGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIAEKTLFPKAKCRIFGANIPGKKNTVYLYLGGLKEYRSVLANCKNHAYVGFDIQLQRSDTKQQANA

SEQ ID NO: 139 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcggcaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 140 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIACIVKDPAIAQKLMPQDLYACRPLCDSGYYNTFNRENVRLEDVKANPIVEITENGVKLENGDFVELDLLICATGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIAEKTLFPKAKCRIFGANIPGGKNTVYLYLGGLKEYRSVLANCKNHAYVGFDIQLQRSDTKQQANA

SEQ ID NO: 141 - DNA, 1632 bp, Artificial Sequence; identical to SEQ ID NO: 137
  Variant of cyclohexanone monooxygenase from Acinetobacter sp NCIMB9871

SEQ ID NO: 142 - protein, 543 aa, Artificial Sequence; identical to SEQ ID NO: 138
  Variant of cyclohexanone monooxygenase from Acinetobacter sp NCIMB9871

SEQ ID NO: 143 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacgaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcatcaatgaatctactgtgccggccatgtccgtaagtgcggaagagcgtaaagcggtttttgagaaggcgtggcgtaccggcggtggtatgcgttttatgttcgaaacctttggtgatattataacgaacatggaagctaacattgaggcacaaaattttattaaaggtaaaatcgcgtgcatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcaaaaagaacaccgtgtacctgtatttgggtgggctgaaaaattaccgctcagttttggcgaattgtaaaaatcatgcgtatgtgggctttgatattcagctgcaacgttctgacacaaaacaacagggcaatgcgtaa

SEQ ID NO: 144 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDEATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALGYGINESTVPAMSVSAEERKAVFEKAWRTGGGMRFMFETFGDIITNMEANIEAQNFIKGKIACIVKDPAIAQKLMPQDLYACRPLCDSGYYNTFNRENVRLEDVKANPIVEITENGVKLENGDFVELDLLICATGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIAEKTLFPKAKCRIFGANIPGKKNTVYLYLGGLKNYRSVLANCKNHAYVGFDIQLQRSDTKQQGNA

SEQ ID NO: 145 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgtttttaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcgaataaaaccctgtttccaaaagccaaatgcaggatttttggggcgaacattccaggcaaaaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 146 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVFNSALGYGVNESTVPAMSVSAEERKAVFEKAWQTGGGMRFMFETFGDIITNMEANIEAQNFIKGKIACIVKDPAIAQKLMPQDLYACRPLCDSGYYNTFNRENVRLEDVKANPIVEITENGVKLENGDFVELDLLICATGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIANKTLFPKAKCRIFGANIPGKKNTVYLYLGGLKEYRSVLANCKNHAYVGFDIQLQRSDTKQQANA

SEQ ID NO: 147 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcggtacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcaaaaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 148 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIACIVKDPAIAQKLMPQDLYACRPLCDSGYYNTFNRENVRLEDVKANPIVEITENGVKLENGDFVELDLLICGTGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIAEKTLFPKAKCRIFGANIPGKKNTVYLYLGGLKEYRSVLANCKNHAYVGFDIQLQRSDTKQQANA

SEQ ID NO: 149 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctacccctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggaggtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgggacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcgaacaaaaccctgtttccaaaagccaaatgcaggatttttggggcgaacattccaggcaaaaagaacaccgtgtacctgtatttgggtgggctgaaaaactaccgctcagttttggcgaattgtaaaaatcatgcgtatgtgggctttgatattcagctgcaacgttctgacacaaaacaacaggcgaatgcgtaa

SEQ ID NO: 150 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSTPNWPNIKGINQFKGELHHTSRWPDDVSIEGKRVGVIGTGSTGVQVITEVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIACIVKDPAIAQKLMPQDLYACRPLCDSGYYNTFNRENVRLEDVKANPIVEITENGVKLENGDFVELDLLICGTGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIANKTLFPKAKCRIFGANIPGKKNTVYLYLGGLKNYRSVLANCKNHAYVGFDIQLQRSDTKQQANA

SEQ ID NO: 151 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctacccctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggaggtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatcaggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgggacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcaaaaagaacaccgtgtacctgtatttgggtgggctgaaaaactaccgctcagttttggcgaattgtaaaaatcatgcgtatgtgggctttgatattcagctgcaacgttctgacacaaaacaacaggcgaatgcgtaa

SEQ ID NO: 152 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSTPNWPNIKGINQFKGELHHTSRWPDDVSIEGKRVGVIGTGSTGVQVITEVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIACIVKDQAIAQKLMPQDLYACRPLCDSGYYNTFNRENVRLEDVKANPIVEITENGVKLENGDFVELDLLICGTGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIAEKTLFPKAKCRIFGANIPGKKNTVYLYLGGLKNYRSVLANCKNHAYVGFDIQLQRSDTKQQANA

SEQ ID NO: 153 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtggaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctacccctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggaggtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggttatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgtgcatcgtcaaagatcaggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacttgctgatctgcgggacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcaaaaagaacaccgtgtacctgtatttgggtgggctgaaagagtaccgctcagttttggcgaattgtaaaaatcatgcgtatgtgggctttgatattcagctgcaacgttctgacacaaaacaacaggcgaatgcgtaa

SEQ ID NO: 154 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVEGPDVRKYLQQVAEKHDLKKSYQFNTAVTSAHYNEADALWEVTTEYGDKYTARFLITAVGLLSTPNWPNIKGINQFKGELHHTSRWPDDVSIEGKRVGVIGTGSTGVQVITEVAPLAKHLTVFQRSPQYSVPIGNDPLSEEDVKKIKDNYDKIWDGVKNSALGYGVNESTVPAMSVSAEERKAVFEKAWQTGGGMRFMFETFGDIITNMEANIEAQNFIKGKIACIVKDQAIAQKLMPQDLYACRPLCDSGYYNTFNRENVRLEDVKANPIVEITENGVKLENGDFVELDLLICGTGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIAEKTLFPKAKCRIFGANIPGKKNTVYLYLGGLKEYRSVLANCKNHAYVGFDIQLQRSDTKQQANA

SEQ ID NO: 155 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcagggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccaccaaggaagcggaggaacagtggacccaaacctgcgccaatattgcggagaaaaccctgtttccaaaagccaaatgcaggatttttggggcgaacattccaggcaaaaagaacaccgtgtacctgtatttgggtggtctgaaagagtaccgctcagttttggcgaattgtaaaaatcatgcgtatgtgggctttgatattcagctgcaacgttctgacacaaaacaacaggcgaatgcgtaa

SEQ ID NO: 156 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRENVRLEDVKANPIVEITENGVKLENGDFVELDMLICATGFDAGDGSYKRIDIQGKNGLAIKDYWKEGPSSYMGVAVNNYPNMFMVFGPNGPLANSPPIIESQVEWISVFIQYTVENNVESIEATKEAEEQWTQTCANIAEKTLFPKAKCRIFGANIPGKKNTVYLYLGGLKEYRSVLANCKNHAYVGFDIQLQRSDTKQQANA

SEQ ID NO: 157 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtaggtggtacatggtactggaaccgctacccgggtgcactgaccgataccgaaacccatttgtattgttattcctgggacaaggaaatgttgcagagtttggaaatcaaaaagaaatacgtgcagggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagtatcgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctatggcgtcaatgaatctactgtgccggccatgtccgtaagtgcggaagagcgtaaagcggtttttgagaaggcgtggcaaaccggcggtggtatgcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgagaacgtacgtctggaggatgtcaaagcaaatccgatcgtcgagatcaccgaaaacggcgtgaaactggaaaacggcgatttcgtggagctggacatgctgatctgcgcgacgggttttgatgcgggtgacggcagctataaacgcattgatatccaagggaaaaacggtctggccattaaggattactggaaagagggcccgtctagctacatgggcgtagcagtgaataattacccaaacatgtttatggttttcggtccaaacggtccactggctaactccccgcctatcattgaaagtcaagttgaatggattagcgtttttatccagtataccgtcgaaaataatgtggaatctattgaagccgacaaggaagcggaggaacagtggacccaaacctgcgccaatattgcggagaaaaccctgtttccaaaagccaaatgcaggatttttggggcgaacattccaggcaaaaagaacaccgtgtacctgtatttgggtggtctgaaagagtaccgctcagttttggcgaattgtaaaaatcatgcgtatgtgggctttgatattcagctgcaacgttctgacacaaaacaacaggcgaatgcgtaa

SEQ ID NO: 158 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVGGTWYWNRYPGALTDTETHLYCYSWDKEMLQSLEIKKKYVQGPDVRKYLQQVAEKHDLKKSYQFNTAVTSAHYNEADALWEVTTEYGDKYTARFLITAVGLLSAPNWPNIKGINQFKGELHHTSRWPDDVSIEGKRVGVIGTGSTGVQVITAVAPLAKHLTVFQRSPQYSVPIGNDPLSEEDVKKIKDNYDKIWDGVKNSALAYGVNESTVPAMSVSAEERKAVFEKAWQTGGGMRFMFETFGDIITNMEANIEAQNFIKGKIARIVKDPAIAQKLMPQDLYACRPLCDSGYYNTFNRENVRLEDVKANPIVEITENGVKLENGDFVELDMLICATGFDAGDGSYKRIDIQGKNGLAIKDYWKEGPSSYMGVAVNNYPNMFMVFGPNGPLANSPPIIESQVEWISVFIQYTVENNVESIEADKEAEEQWTQTCANIAEKTLFPKAKCRIFGANIPGKKNTVYLYLGGLKEYRSVLANCKNHAYVGFDIQLQRSDTKQQANA

SEQ ID NO: 159 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttcatggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 160 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVHGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 161 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttcagggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 162 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVQGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 163 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccacatgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 164 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPHANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 165 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccaaaggctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 166 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPKANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 167 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccaactgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 168 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPTANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 169 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagatgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 170 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPDANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 171 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccatgtgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 172 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPCANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 173 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccaattgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 174 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPIANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 175 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccacttgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 176 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPLANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 177 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccatatgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 178 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPYANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 179 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagcctttaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 180 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAFNSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 181 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccaagaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 182 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAKNSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 183 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagcctggaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 184 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAWNSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 185 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcgagatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 186 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSEIFGANIPGKKNTVYFYLGGLKEYRSALANCKNHAYEGFDIQLQRSDIKQPANA

SEQ ID NO: 187 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagccctatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 188 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSPIFGANIPGKKNTVYFYLGGLKEYRSALANCKNHAYEGFDIQLQRSDIKQPANA

SEQ ID NO: 189 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggtgttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 190 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGVRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 191 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcattttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 192 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFHFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 193 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttatatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 194 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRYMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 195 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgtttttggttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 196 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFWFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 197 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgcatgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 198 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMHETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 199 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcagctcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 200 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAARPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 201 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatcgcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 202 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYASRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 203 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcacttcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 204 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYALRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 205 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcagatcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 206 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYADRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 207 - DNA, 1632 bp, Artificial Sequence
  Variant of cyclohexanone monooxygenase from Acinetobacter sp NCIMB9871
atgtctcagaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcaaaacgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcaactatgttcgcatggatatccaagggaaaaacggtctggccatgaaggattactggaaagagggcccgtctagctacatgggcgtaaccgtgaataattacccaaacatgtttatggttctgggtccaaacggtccagccgctaactccccgcctagcattgaaagtcaagttgaatggattagcgatactatccagtataccgtcgaaaataacgtggaatctattgaagccacgaaggaagcggaggaacagtggacccaaacctgcgccaatattgcggagatgaccctgtttccaaaagcccagcctaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 208 - protein, 543 aa, Artificial Sequence
  Variant of cyclohexanone monooxygenase from Acinetobacter sp NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPAANSPPSIESQVEWISDTIQYTVENNVESIEATKEAEEQWTQTCANIAEMTLFPKAQPRIFGANIPGKKNTVYFYLGGLKEYRSALANCKNHAYEGFDIQLQRSDIKQPANA

SEQ ID NO: 209 - DNA, 1632 bp, Artificial Sequence
  Variant of cyclohexanone monooxygenase from Acinetobacter sp NCIMB9871
atgtctaccaagatggatttcgatgctatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacatgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 210 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNMPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 211 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggtctgcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 212 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGLRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 213 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttggcttctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 214 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLASAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 215 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttaactttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 216 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFNFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 217 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtgtcctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 218 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGVLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 219 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtaacctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 220 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGNLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 221 - DNA, 1632 bp, Artificial Sequence
  Variant of cyclohexanone monooxygenase from Acinetobacter sp NCIMB9871
atgtctaccaagatggatttcgatgccatcgtgatcggtgggggctttggcggtctgtatgccgttaaaaaactgcgcgatgaactggagctgaaagttcaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagtttcgaaggcaaacgtgtgggtgtgatcggcacaggctctaccggcgtgcaagttatcacggcagtggcgccactggccaagcacctgacggtgtttcagcgtagtgcccagtactcggtcccgatcggtaacgatccactgagcgaagaagacgtcaagaagatcaaagataactatgataaaatctgggatggtgtttggaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattgccacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtaaccgtgaataattacccaaacatgtttatggttctgggtccaaacggtccactgctgaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagctttggcgaattgtaaaaatcatgcgtatgaaggctttgatattcagctgcaacgttctgacatcaaacaaccagcgaatgcgtaa

SEQ ID NO: 222 - protein, 543 aa, Artificial Sequence
  Variant of cyclohexanone monooxygenase from Acinetobacter sp NCIMB9871
MSTKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVTVNNYPNMFMVLGPNGPLLNSPPIIESQVEWISVTIQYTVENNVESIEATKEAEEQWTQTCANIAEMTLFPKAQSRIFGANIPGKKNTVYFYLGGLKEYRSALANCKNHAYEGFDIQLQRSDIKQPANA

SEQ ID NO: 223 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaactttccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 224 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNFPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 225 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccttaggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgggtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 226 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLGDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 227 - DNA, 1632 bp, Artificial Sequence
  Variant of cyclohexanone monooxygenase from Acinetobacter sp NCIMB9871
atgtctaccaagatggatttcgatgccatcgtgatcggtgccggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtcggtttgctgtctgtgcctaacctgccaaatatcaagggcatcaatcagtttaaaggcgaactgcaccatacttcccgctggccggatgacgtgagtctggaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctgggtttcggcctgaatgaatctactgtgccggccatgtccgtaagtgcggaagagcgtaaagcggtttttgagaaggcgtggcaaaccggcggtggtttacgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgggtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggtttttggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagagcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 228 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSVPNLPNIKGINQFKGELHHTSRWPDDVSLEGKRVGVIGTGSTGVQVITAVAPLAKHLTVFQRSPQYSVPIGNDPLSEEDVKKIKDNYDKIWDGVKNSALGFGLNESTVPAMSVSAEERKAVFEKAWQTGGGLRFMFETFGDIITNMEANIEAQNFIKGKIAEIVKDPAIAQKLMPQDLYACRPLGDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVTIQYTVENNVESIEATKEAEEQWTQTCANIAEMTLFPKAQSRIFGANIPGKKNTVYFYLGGLKEYRSVLANCKNHAYEGFDIQLQRSDTKQPANA

SEQ ID NO: 229 - DNA, 1632 bp, Artificial Sequence
  Variant of cyclohexanone monooxygenase from Acinetobacter sp NCIMB9871
atgtctaccaagatggatttcgatgccatcgtgatcggtgggggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttctctacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttctgggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagtgcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 230 - protein, 543 aa, Artificial Sequence
  Variant of cyclohexanone monooxygenase from Acinetobacter sp NCIMB9871
MSTKMDFDAIVIGGGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFSTFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVLGPNGPLANSPPIIESQVEWISVTIQYTVENNVESIEATKEAEEQWTQTCANIAEMTLFPKAQCRIFGANIPGKKNTVYFYLGGLKEYRSVLANCKNHAYEGFDIQLQRSDTKQPANA

SEQ ID NO: 231 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagtgcaggatttttggggcgaacattccaggcaagaagaacaccgtgtacttatatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 232 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVTIQYTVENNVESIEATKEAEEQWTQTCANIAEMTLFPKAQCRIFGANIPGKKNTVYLYLGGLKEYRSVLANCKNHAYEGFDIQLQRSDTKQPANA

SEQ ID NO: 233 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtccaatctgcccactacaacgaagcggacgctctgtgggaagtaactacggaatacggggataagtacaccgcacgtttcctgattactgccgtgggtttgctgtctgcacctaactggccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcggagatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctatgttcgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagatgaccctgtttccaaaagcccagtgcaggatttttggggcgaacattccaggcaagaagaacaccgtgtacttttatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 234 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITAVGLLSAPNWPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIAEIVKDPAIAQKLMPQDLYACRPLCDSGYYNTFNRDNVRLEDVKANPIVEITENGVKLENGDFVELDMLICATGFDAVDGSYVRMDIQGKNGLAMKDYWKEGPSSYMGVAVNNYPNMFMVFGPNGPLANSPPIIESQVEWISVTIQYTVENNVESIEATKEAEEQWTQTCANIAEMTLFPKAQCRIFGANIPGKKNTVYFYLGGLKEYRSVLANCKNHAYEGFDIQLQRSDTKQPANA

SEQ ID NO: 235 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccgagggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 236 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAEGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 237 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcccatggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 238 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAHGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 239 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcccagggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 240 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAQGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 241 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcctcgggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 242 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALASGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 243 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggtcagcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 244 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGQRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 245 - DNA, 1632 bp, Artificial Sequence; identical to SEQ ID NO: 87
  Variant of cyclohexanone monooxygenase from Acinetobacter sp NCIMB9871

SEQ ID NO: 246 - protein, 543 aa, Artificial Sequence; identical to SEQ ID NO: 88
  Variant of cyclohexanone monooxygenase from Acinetobacter sp NCIMB9871

SEQ ID NO: 247 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttgggttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 248 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFGFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 249 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttggttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 250 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFGFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 251 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttcggttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 252 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFRFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 253 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggtttttcgtttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 254 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFSFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 255 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatggctgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 256 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMAETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 257 - DNA, 1632 bp, Artificial Sequence
  Variant of cyclohexanone monooxygenase from Acinetobacter sp NCIMB9871
atgtctaccaagatggatttcgatgccatcgtgatcggtgcaggatttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgagtgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 258 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMSETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 259 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaagttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagccaagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 260 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAKCRIFGANIPGKKNTVYLYLGGLKEYRSVLANCKNHAYEGFDIQLQRSDTKQPANA

SEQ ID NO: 261 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagccttttgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 262 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAFCRIFGANIPGKKNTVYLYLGGLKEYRSVLANCKNHAYEGFDIQLQRSDTKQPANA

SEQ ID NO: 263 - DNA, 1632 bp, Artificial Sequence
  Variant of cyclohexanone monooxygenase from Acinetobacter sp NCIMB9871
atgtctaccaagatggatttcgatgccatcgtgatcggtgcaggttttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggccttcggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagccctgtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 264 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALAFGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKALCRIFGANIPGKKNTVYLYLGGLKEYRSVLANCKNHAYEGFDIQLQRSDTKQPANA

SEQ ID NO: 265 - DNA, 1632 bp, Artificial Sequence
  Variant of cyclohexanone monooxygenase from Acinetobacter sp NCIMB9871
atgtctaccaagatggatttcgatgccatcgtgatcggtgcaggatttggcggtctgtatgccgttaaaaaactgcgcgatgaactggagctgaaagttaaagccttcgacaaggcaactgacgtagcgggtacatggtactggaaccgctacccgggtgcactgaccgataccgaaacccatttgtattgttattcctgggacaaggaactgttgcagagtttggaaatcaaaaagaaatacgtgcaaggtccagacgtgcgcaaatatctgcagcaggttgccgaaaaacacgacttaaaaaaaagctaccagttcaacaccgcagtcacatctgcccactacaacgaagcggacgctctgtgggaagtaactacggaatacggggataagtacaccgcacgtttcctgattactgccgtgggtttgctgtctgcacctaacctgccaaatatcaagggcatcaatcagtttaaaggcgaactgcaccatacttcccgctggccggatgacgtgagttttgaaggcaaacgtgtgggtgtgatcggcacaggctctaccggcgtgcaagttatcacggcagtggcgccactggccaagcacctgacggtgtttcagcgtagtccgcagtactcggtcccgatcggtaacgatccactgagcgaagaagacgtcaagaagatcaaagataactatgataaaatctgggatggtgttaaaaacagtgcgctggcccggggcctgaatgaatctactgtgccggccatgtccgtaagtgcggaagagcgtaaagcggtttttgagaaggcgtggcaaaccggcggtggttttcgttttatgttcgaaacctttggtgatattataacgaacatggaagctaacattgaggcacaaaattttattaaaggtaaaatcgcgcgtatcgtcaaagatccggcgatcgcccaaaaactgatgccgcaggatctgtacgcatgtcgccctctgtgtgactccgggtactataatacgttcaatcgcgacaacgtacgtctggaggatgtcaaagcaaatccgatcgtcgagatcaccgaaaacggcgtgaaactggaaaacggcgatttcgtggagctggacatgctgatctgcgcgacgggttttgatgcggtagacggcagctataaacgcatggatatccaagggaaaaacggtctggccatgaaggattactggaaagagggcccgtctagctacatgggcgtagcagtgaataattacccaaacatgtttatggttttcggtccaaacggtccactggctaactccccgcctatcattgaaagtcaagttgaatggattagcgttactatccagtataccgtcgaaaataatgtggaatctattgaagccacgaaggaagcggaggaacagtggacccaaacctgcgccaatattgcggagaaaaccctgtttccaaaagcccagtgcaggatttttggggcgaacattccaggcaagaagaacaccgtgtacctgtatttgggtgggctgaaagagtaccgctcagttttggcgaattgtaaaaatcatgcgtatgaaggctttgatattcagctgcaacgttctgacacaaaacaaccagcgaatgcgtaa

SEQ ID NO: 266 - protein, 543 aa, Artificial Sequence
  Variant of cyclohexanone monooxygenase from Acinetobacter sp NCIMB9871
MSTKMDFDAIVIGAGFGGLYAVKKLRDELELKVKAFDKATDVAGTWYWNRYPGALTDTETHLYCYSWDKELLQSLEIKKKYVQGPDVRKYLQQVAEKHDLKKSYQFNTAVTSAHYNEADALWEVTTEYGDKYTARFLITAVGLLSAPNLPNIKGINQFKGELHHTSRWPDDVSFEGKRVGVIGTGSTGVQVITAVAPLAKHLTVFQRSPQYSVPIGNDPLSEEDVKKIKDNYDKIWDGVKNSALARGLNESTVPAMSVSAEERKAVFEKAWQTGGGFRFMFETFGDIITNMEANIEAQNFIKGKIARIVKDPAIAQKLMPQDLYACRPLCDSGYYNTFNRDNVRLEDVKANPIVEITENGVKLENGDFVELDMLICATGFDAVDGSYKRMDIQGKNGLAMKDYWKEGPSSYMGVAVNNYPNMFMVFGPNGPLANSPPIIESQVEWISVTIQYTVENNVESIEATKEAEEQWTQTCANIAEKTLFPKAQCRIFGANIPGKKNTVYLYLGGLKEYRSVLANCKNHAYEGFDIQLQRSDTKQPANA

SEQ ID NO: 267 - DNA, 759 bp, Artificial Sequence
  Variant of KRED from Lactobacillus kefiri
atgaccgatcgtctgaagggcaaagtagccatcgtaaccggcgggactctgggtatcggtttggcgatcgccgataaatttgtagaggagggtgcgaaagtagttattactggtcgtcacgcggatgtaggtgaaaaggccgccaaatcaatcggcggcactgatgttattcgctttgtccagcacgatgcatccgatgaagcaggctggacgaaactgttcgacaccaccgaggaggcattcggcccggttacgaccgtcgtgaacaatgcagggattttcgtttataaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattgaggggctggtaggcgatccgacgggtggggcatacaacgcttccaagggggcggtacgtatcatgtcgaaaagcgcagcgctggattgcgcactgaaggactacgatgtgcgtgtcaacacagtacatccgggctatatcaagaccccgctggtcgatgatctggaaggtgctgaggaaatgatgtcacagcgtacgaaaacccctatgggccacattggcgaaccgaatgacatcgcatggatctgtgtgtacctggcatctgacgaatcgaaatttgcgacgggtgcagaatttgtggtcgacggcgggtataccgcacagtga

SEQ ID NO: 268 - protein, 252 aa, Artificial Sequence
  Variant of KRED from Lactobacillus kefiri
MTDRLKGKVAIVTGGTLGIGLAIADKFVEEGAKVVITGRHADVGEKAAKSIGGTDVIRFVQHDASDEAGWTKLFDTTEEAFGPVTTVVNNAGIFVYKSVEDTTTEEWRKLLSVNLDGVFFGTRLGIQRMKNKGLGASIINMSSIEGLVGDPTGGAYNASKGAVRIMSKSAALDCALKDYDVRVNTVHPGYIKTPLVDDLEGAEEMMSQRTKTPMGHIGEPNDIAWICVYLASDESKFATGAEFVVDGGYTAQ

What is claimed is:

1. A non-naturally occurring monooxygenase, wherein said monooxygenase comprises a polypeptide sequence having at least 90% identity to SEQ ID NO:124, and wherein said monooxygenase is capable of converting 5-methoxy-2-((4-methoxy-3,5-dimethylpyridin-2-yl)methylthio)-1H-benzo[d]imidazole ("compound (1)") to 5-methoxy-2-((4-methoxy-3,5-dimethylpyridin-2-yl)methylsulfinyl)-1H-benzo[d]imidazole ("compound (2)"), and wherein said polypeptide sequence
has two or more residue differences as compared to SEQ ID NO:2 at the following residue positions: position corresponding to X246; position corresponding to position corresponding to X248; position corresponding to X326; position corresponding to X386; position corresponding to X432; position corresponding to X433; position corresponding to X435; position corresponding to X438; and position corresponding to X448.

2. The non-naturally occurring monooxygenase of claim 1, wherein said monooxygenase is capable of converting the compound (1) to (S)-5-methoxy-2-((4-methoxy-3,5-dimethylpyridin-2-yl)methylsulfinyl)-1H-benzo[d]imidazole ("compound (2b)") in enantiomeric excess.

3. The non-naturally occurring monooxygenase of claim 2, wherein said polypeptide sequence comprises a cysteine at position X326.

4. The non-naturally occurring monooxygenase of claim 2, wherein said polypeptide sequence comprises a serine at position X386.

5. The non-naturally occurring monooxygenase of claim 2 in which the amino acid sequence comprises at least the following features:
residue at position corresponding to X326 is C;
residue at position corresponding to X386 is S; and
residue at position corresponding to X432 is A, or L.

6. The non-naturally occurring monooxygenase of claim 5 in which the amino acid sequence further comprises one or more of the following features:
residue at position corresponding to X433 is A, L, or V;
residue at position corresponding to X435 is S;
residue at position corresponding to X438 is I;
residue at position corresponding to X448 is V or W; and
residue at position corresponding to X490 is R.

7. The non-naturally occurring monooxygenase of claim 2 in which the amino acid sequence comprises one or more of the following features:
residue at position corresponding to X3 is T;
residue at position corresponding to X14 is A;
residue at position corresponding to X34 is K;
residue at position corresponding to X43 is G;
residue at position corresponding to X71 is M;
residue at position corresponding to X83 is E;
residue at position corresponding to X111 is T;
residue at position corresponding to X141 is I or V;
residue at position corresponding to X174 is L or I;
residue at position corresponding to X209 is P;
residue at position corresponding to X240 is F, or K;
residue at position corresponding to X246 is E, H, Q, S, R, W, or Y;
residue at position corresponding to X248 is C, I, N, V, or S;
residue at position corresponding to X277 is L, M, or Q;
residue at position corresponding to X278 is G, N, or S;
residue at position corresponding to X280 is G, or R;
residue at position corresponding to X281 is A, or S;
residue at position corresponding to X282 is S;
residue at position corresponding to X288 is I;
residue at position corresponding to X307 is C or R;
residue at position corresponding to X341 is E;
residue at position corresponding to X373 is L;
residue at position corresponding to X377 is G;
residue at position corresponding to X388 is K;
residue at position corresponding to X390 is R or I;
residue at position corresponding to X400 is I;
residue at position corresponding to X415 is A;
residue at position corresponding to X426 is F;
residue at position corresponding to X449 is M, F or L;
residue at position corresponding to X464 is D;
residue at position corresponding to X481 is K;
residue at position corresponding to X488 is F, K, or L;
residue at position corresponding to X489 is a C;
residue at position corresponding to X499 is L;
residue at position corresponding to X505 is W or L;
residue at position corresponding to X516 is V;
residue at position corresponding to X526 is V;
residue at position corresponding to X537 is T; and
residue at position corresponding to X540 is Q, or A.

8. The non-naturally occurring monooxygenase of claim 2 in which the amino acid sequence comprises a sequence selected from the group consisting of SEQ ID NO: 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 210, 212, 214, 216, 218, 220, 222, 224, 226, 228, 230, 232, 234, 236, 238, 240, 242, 244, 246, 248, 250, 252, 254, 256, 258, 260, 262, 264, and 266.

9. The non-naturally occurring monooxygenase of claim 2 in which the amino acid sequence comprises at least the following features:

(a) residue at position corresponding to X326 is C; residue at position corresponding to X386 is S; residue at position corresponding to X432 is A, or L; residue at position corresponding to X433 is A; residue at position corresponding to X435 is S; and residue at position corresponding to X490 is R;

(b) residue at position corresponding to X34 is K; residue at position corresponding to X209 is P; residue at position corresponding to X240 is K; residue at position corresponding to X288 is I; residue at position corresponding to X326 is C; residue at position corresponding to X386 is S; residue at position corresponding to X415 is A; residue at position corresponding to X432 is L; residue at position corresponding to X433 is A; residue at position corresponding to X435 is S; residue at position corresponding to X438 is I; residue at position corresponding to X448 is V; residue at position corresponding to X490 is R; residue at position corresponding to X516 is V; and residue at position corresponding to X537 is T;

(c) residue at position corresponding to X14 is A; residue at position corresponding to X34 is K; residue at position corresponding to X141 is V; residue at position corresponding to X209 is P; residue at position corresponding to X240 is K; residue at position corresponding to X288 is I; residue at position corresponding to X326 is C; residue at position corresponding to X386 is S; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X489 is C; residue at position corresponding to X490 is R; residue at position corresponding to X516 is V; and residue at position corresponding to X537 is T;

(d) residue at position corresponding to X14 is A; residue at position corresponding to X34 is K; residue at position corresponding to X111 is T; residue at position corresponding to X141 is V; residue at position corresponding to X209 is P; residue at position corresponding to X240 is K; residue at position corresponding to X246 is Y; residue at position corresponding to X288 is I; residue at position corresponding to X307 is R; residue at position corresponding to X326 is C; residue at position corresponding to X386 is S; residue at position corresponding to X388 is K; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X481 is K; residue at position corresponding to X489 is C; residue at position corresponding to X490 is R; residue at position corresponding to X505 is L; residue at position corresponding to X516 is V; and residue at position corresponding to X537 is T;

(e) residue at position corresponding to X14 is A; residue at position corresponding to X34 is K; residue at position corresponding to X43 is G; residue at position corresponding to X71 is M; residue at position corresponding to X111 is T; residue at position corresponding to X141 is V; residue at position corresponding to X149 is W; residue at position corresponding to X209 is P; residue at position corresponding to X240 is K; residue at position corresponding to X246 is Y; residue at position corresponding to X248 is V; residue at position corresponding to X277 is M; residue at position corresponding to X288 is I; residue at position corresponding to X307 is R; residue at position corresponding to X326 is C; residue at position corresponding to X386 is S; residue at position corresponding to X388 is K; residue at position corresponding to X390 is I; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X481 is K; residue at position corresponding to X489 is C; residue at position corresponding to X490 is R; residue at position corresponding to X499 is L; residue at position corresponding to X505 is L; residue at position corresponding to X516 is V; residue at position corresponding to X526 is V; residue at position corresponding to X537 is T; and residue at position corresponding to X540 is Q; or (g) residue at position corresponding to X14 is A; residue at position corresponding to X34 is K; residue at position corresponding to X43 is G; residue at position corresponding to X71 is M; residue at position corresponding to X83 is E; residue at position corresponding to X111 is T; residue at position corresponding to X141 is V; residue at position corresponding to X149 is W; residue at position corresponding to X174 is I; residue at position corresponding to X209 is P; residue at position corresponding to X240 is F or K; residue at position corresponding to X246 is Y; residue at position corresponding to X248 is I or V; residue at position corresponding to X277 is M; residue at position corresponding to X288 is I; residue at position corresponding to X307 is C or R; residue at position corresponding to X326 is C; residue at position corresponding to X341 is E; residue at position corresponding to X373 is L; residue at position corresponding to X377 is G; residue at position corresponding to X383 is G; residue at position corresponding to X386 is S; residue at position corresponding to X388 is K; residue at position corresponding to X390 is I; residue at position corresponding to X400 is I; residue at position corresponding to X415 is A; residue at position corresponding to X426 is F; residue at position corresponding to X432 is L; residue at position corresponding to X433 is A; residue at position corresponding to X435 is S; residue at position corresponding to X438 is I; residue at position corresponding to X448 is V; residue at position corresponding to X449 is F; residue at position corresponding to X464 is D; residue at position corresponding to X481 is K; residue at position corresponding to X488 is K; residue at position corresponding to X489 is C; residue at position corresponding to X490 is R; residue at position corresponding to X499 is L; residue at position corresponding to X505 is L; residue at position corresponding to X516 is V; residue at position corresponding to X526 is V; residue at position corresponding to X537 is T; and residue at position corresponding to X540 is Q.

10. The non-naturally occurring monooxygenase of claim 1 in which the polypeptide is capable of converting the compound (1) to (R)-5-methoxy-2-((4-methoxy-3,5-dimethylpyridin-2-yl)methylsulfinyl)-1H-benzo[d]imidazole ("compound (2a)") in enantiomeric excess, and in which the amino acid sequence comprises at least two or more of the following features:

residue at position corresponding to X432 is A, C, D, H, K, I, S, T, or Y;

residue at position corresponding to X433 is A, F, G, K, or W;

residue at position corresponding to X435 is A or S; and residue at position corresponding to X490 is R.

11. The non-naturally occurring monooxygenase of claim 10 in which the amino acid sequence comprises a sequence selected from the group consisting of SEQ ID NO: 4, 6, 160, 162, 164, 166, 168, 170, 172, 174, 176, 178, 180, 182, 184, 186, 188, 190, 192, 194, 196, 198, 200, 202, 204, 206, and 208.

* * * * *

UNITED STATES PATENT AND TRADEMARK OFFICE
CERTIFICATE OF CORRECTION

| | | |
|---|---|---|
| PATENT NO. | : 8,895,271 B2 | Page 1 of 1 |
| APPLICATION NO. | : 13/514750 | |
| DATED | : November 25, 2014 | |
| INVENTOR(S) | : Bong et al. | |

It is certified that error appears in the above-identified patent and that said Letters Patent is hereby corrected as shown below:

In the Claims

In Column 95, Claim 1, Line 34-35, please delete "position corresponding to".

Signed and Sealed this
Thirty-first Day of March, 2015

Michelle K. Lee
*Director of the United States Patent and Trademark Office*